United States Patent
Ollmann et al.

(10) Patent No.: US 10,870,856 B2
(45) Date of Patent: Dec. 22, 2020

(54) RNAI CONSTRUCTS FOR INHIBITING ASGR1 EXPRESSION AND METHODS OF USE THEREOF

(71) Applicant: AMGEN INC., Thousand Oaks, CA (US)

(72) Inventors: Michael Ollmann, San Carlos, CA (US); Yang Li, Mountain View, CA (US); Jun Zhang, Foster City, CA (US); Oliver Homann, Berkeley, CA (US); Leslie P. Miranda, Thousand Oaks, CA (US); Justin K. Murray, Moorpark, CA (US); Bin Wu, Thousand Oaks, CA (US); Oh Kyu Yoon, Pacifica, CA (US); John Gordon Allen, Newbury Park, CA (US); Chawita Netirojjanakul, Sherman Oaks, CA (US)

(73) Assignee: AMGEN INC., Thousand Oaks, CA (US)

( * ) Notice: Subject to any disclaimer, the term of this patent is extended or adjusted under 35 U.S.C. 154(b) by 0 days.

(21) Appl. No.: 16/328,221

(22) PCT Filed: Aug. 25, 2017

(86) PCT No.: PCT/US2017/048757
§ 371 (c)(1),
(2) Date: Feb. 25, 2019

(87) PCT Pub. No.: WO2018/039647
PCT Pub. Date: Mar. 1, 2018

(65) Prior Publication Data
US 2019/0309306 A1 Oct. 10, 2019

Related U.S. Application Data

(60) Provisional application No. 62/380,216, filed on Aug. 26, 2016.

(51) Int. Cl.
*C12N 15/113* (2010.01)
*A61P 9/10* (2006.01)
*A61P 3/06* (2006.01)
*C07K 16/28* (2006.01)

(52) U.S. Cl.
CPC ............ *C12N 15/1138* (2013.01); *A61P 3/06* (2018.01); *A61P 9/10* (2018.01); *C07K 16/2851* (2013.01); *C07K 2317/526* (2013.01); *C12N 2310/14* (2013.01); *C12N 2310/315* (2013.01); *C12N 2310/317* (2013.01); *C12N 2310/321* (2013.01); *C12N 2310/332* (2013.01); *C12N 2310/351* (2013.01); *C12N 2310/3513* (2013.01)

(58) Field of Classification Search
CPC ............ A01K 2207/05; C12N 2310/14; C12N 2310/31; C12N 2310/32; C12N 2310/33
See application file for complete search history.

(56) References Cited

U.S. PATENT DOCUMENTS

| 2005/0255487 A1* | 11/2005 | Khvorova | A61K 31/713 435/6.11 |
| 2007/0031844 A1* | 2/2007 | Khvorova | A61K 31/713 435/6.11 |
| 2008/0269450 A1* | 10/2008 | Wakefield | A61K 47/58 527/312 |
| 2013/0024961 A1 | 1/2013 | Burlak et al. | |
| 2017/0088620 A1* | 3/2017 | Nioi | A61K 39/3955 |

FOREIGN PATENT DOCUMENTS

| CN | 1587408 A | 3/2005 | |
| WO | WO-2006034488 A2 * | 3/2006 | A61K 47/6889 |

OTHER PUBLICATIONS

Gu et al. (2016), "The asialoglycoprotein receptor suppresses the metastasis of hepatocellular carcinoma via LASS2-mediated inhibition of V-ATPase activity", Cancer Letters, 379:107-116.
Nioi et al. (2016), "Variant ASGR1 associated with a reduced risk of coronary artery disease", N. Engl. J. Med., 374:2131-2141.
Paris et al. (2011), "ASGR1 expressed by porcine enriched liver sinusoidal endothelial cells mediates human platelet phagocytosis in vitro", Xenotransplantation, 18:245-251.
Yamamoto et al. (2016), "Serial incorporation of a monovalent GalNAc phosphoramidite unit into hepatocyte-targeting antisense oligonucleotides", Bioorg. Med. Chem., 24:26-32.
Yang et al. (2006), "Antisense oligonucleotides targeted against asialoglycoprotein receptor 1 block human hepatitis B virus replication", J. Viral Hepatitis, 13:158-165.
Yang et al. (2016), "Kukoamine B promotes TLR4-independent lipopolysaccharide uptake in murine hepatocytes", Oncotarget, 7(36):57498-57513.
Written Opinion and International Search Report for Appl. No. PCT/US2017/048757 dated Feb. 5, 2018.

* cited by examiner

*Primary Examiner* — Brian Whiteman
(74) *Attorney, Agent, or Firm* — Angela L. Purcell

(57) ABSTRACT

The present invention relates to RNAi constructs for reducing expression of the ASGR1 gene. Methods of using such RNAi constructs to treat or prevent cardiovascular disease, such as coronary artery disease and myocardial infarction, and to reduce serum non-HDL cholesterol levels are also described.

36 Claims, 12 Drawing Sheets
Specification includes a Sequence Listing.

1 CCCAAACGGT GCACGGAAGA GTGAGGTGAC TGGCATGTGT GGGGGCAACA CGATTCTCCT

61 CCCTGGGGAG CAGAGCAGAG GCAACCCATC CCCCACTCCC ACCCCACAC TCCCCTAAGT

121 TCCAATCCAT TTCCACCTCT GTTTACTGTC CAAAGTCCCG GGCACTGGAG ATGCCACGTT

181 TGGCGTGCTT GGACACACAG ACACGCAGAC ACAGAGACAC CGGGGCCCAG GGCCCTCCTA

241 TGGACCCTGC CCGCTCCCCT CCCATTGTCC ACGGCTGTCC GCCCACCCCC ATTCTCCAAG

301 CTTCAGCCCC CTCCTTAGTT CGGCATCTGC ACAGCACTGA AGAACCTGGG AATCAGACCC

361 TGAGACCCTG AGCAATCCCA GGTCCAGCGC CAGCCCTATC ATGACCAAGG AGTATCAAGA

421 CCTTCAGCAT CTGGACAATG AGGAGAGTGA CCACCATCAG CTCAGAAAAG GGCCACCTCC

481 TCCCCAGCCC CTCCTGCAGC GTCTCTGCTC CGGACCTCGC CTCCTCCTGC TCTCCCTGGG

541 CCTCAGCCTC CTGCTGCTTG TGGTTGTCTG TGTGATCGGA TCCCAAAACT CCCAGCTGCA

601 GGAGGAGCTG CGGGGCCTGA GAGAGACGTT CAGCAACTTC ACAGCGAGCA CGGAGGCCCA

661 GGTCAAGGGC TTGAGCACCC AGGGAGGCAA TGTGGGAAGA AAGATGAAGT CGCTAGAGTC

721 CCAGCTGGAG AAACAGCAGA AGGACCTGAG TGAAGATCAC TCCAGCCTGC TGCTCCACGT

781 GAAGCAGTTC GTGTCTGACC TGCGGAGCCT GAGCTGTCAG ATGGCGGCGC TCCAGGGCAA

841 TGGCTCAGAA AGGACCTGCT GCCCGGTCAA CTGGGTGGAG CACGAGCGCA GCTGCTACTG

901 GTTCTCTCGC TCCGGGAAGG CCTGGGCTGA CGCCGACAAC TACTGCCGGC TGGAGGACGC

961 GCACCTGGTG GTGGTCACGT CCTGGGAGGA GCAGAAATTT GTCCAGCACC ACATAGGCCC

1021 TGTGAACACC TGGATGGGCC TCCACGACCA AAACGGGCCC TGGAAGTGGG TGGACGGGAC

1081 GGACTACGAG ACGGGCTTCA GAACTGGAG GCCGGAGCAG CCGGACGACT GGTACGGCCA

1141 CGGGCTCGGA GGAGGCGAGG ACTGTGCCCA CTTCACCGAC GACGGCCGCT GGAACGACGA

1201 CGTCTGCCAG AGGCCCTACC GCTGGGTCTG CGAGACAGAG CTGGACAAGG CCAGCCAGGA

1261 GCCACCTCTC CTTTAATTTA TTTCTTCAAT GCCTCGACCT GCCGCAGGGG TCCGGGATTG

1321 GGAATCCGCC CATCTGGGGG CCTCTTCTGC TTTCTCGGGA ATTTTCATCT AGGATTTTAA

1381 GGGAAGGGGA AGGATAGGGT GATGTTCCGA AGGTGAGGAG CTTGAAACCC GTGGCGCTTT

1441 CTGCAGTTTG CAGGTTATCA TTGTGAACTT TTTTTTTTTA AGAGTAAAAA GAAATATACC

1501 TAAAAAAAAA AAAAAAAA (SEQ ID NO: 1)

FIG. 1A

```
   1 CCCAAACGGT GCACGGAAGA GTGAGGTGAC TGGCATGTGT GGGGGCAACA CGATTCTCCT
  61 CCCTGGGGAG CAGAGCAGAG GCAACCCATC CCCCACTCCC ACCCCACAC TCCCCTAAGT
 121 TCCAATCCAT TTCCACCTCT GTTTACTGTC CAAAGTCCCG GGCACTGGAG ATGCCACGTT
 181 TGGCGTGCTT GGACACACAG ACACGCAGAC ACAGAGACAC CGGGGCCCAG GGCCCTCCTA
 241 TGGACCCTGC CCGCTCCCCT CCCATTGTCC ACGGCTGTCC GCCCACCCCC ATTCTCCAAG
 301 CTTCAGCCCC CTCCTTAGTT CGGCATCTGC ACAGCACTGA GAACCTGGG AATCAGACCC
 361 TGAGACCCTG AGCAATCCCA GGTCCAGCGC CAGCCCTATC ATGACCAAGG AGTATCAAGA
 421 CCTTCAGCAT CTGGACAATG AGGAGAGTGA CCACCATCAG CTCAGAAAAG ACTCCAGCT
 481 GCAGGAGGAG CTGCGGGGCC TGAGAGAGAC GTTCAGCAAC TTCACAGCGA GCACGGAGGC
 541 CCAGGTCAAG GGCTTGAGCA CCCAGGGAGG CAATGTGGGA AGAAAGATGA AGTCGCTAGA
 601 GTCCCAGCTG GAGAAACAGC AGAAGGACCT GAGTGAAGAT CACTCCAGCC TGCTGCTCCA
 661 CGTGAAGCAG TTCGTGTCTG ACCTGCGGAG CCTGAGCTGT CAGATGGCGG CGCTCCAGGG
 721 CAATGGCTCA GAAAGGACCT GCTGCCCGGT CAACTGGGTG GAGCACGAGC GCAGCTGCTA
 781 CTGGTTCTCT CGCTCCGGGA AGGCCTGGGC TGACGCCGAC AACTACTGCC GGCTGGAGGA
 841 CGCGCACCTG GTGGTGGTCA CGTCCTGGGA GGAGCAGAAA TTTGTCCAGC ACCACATAGG
 901 CCCTGTGAAC ACCTGGATGG GCCTCCACGA CCAAAACGGG CCCTGGAAGT GGGTGGACGG
 961 GACGGACTAC GAGACGGGCT TCAAGAACTG GAGGCCGGAG CAGCCGGACG ACTGGTACGG
1021 CCACGGGCTC GGAGGAGGCG AGGACTGTGC CCACTTCACC GACGACGGCC GCTGGAACGA
1081 CGACGTCTGC CAGAGGCCCT ACCGCTGGGT CTGCGAGACA GAGCTGGACA AGGCCAGCCA
1141 GGAGCCACCT CTCCTTTAAT TTATTTCTTC AATGCCTCGA CCTGCCGCAG GGGTCCGGGA
1201 TTGGGAATCC GCCCATCTGG GGGCCTCTTC TGCTTTCTCG GAATTTTCA TCTAGGATTT
1261 TAAGGGAAGG GGAAGGATAG GGTGATGTTC CGAAGGTGAG GAGCTTGAAA CCCGTGGCGC
1321 TTTCTGCAGT TTGCAGGTTA TCATTGTGAA CTTTTTTTT TTAAGAGTAA AAAGAAATAT
1381 ACCTAAAAAA AAAAAAAAAA AA (SEQ ID NO: 2)
```

FIG. 1B

```
   1 CACATGGGCC CTGGATGGAC CCTGTCCCCT CCCCTCCCAT TGCCCAGGGC TCTTCACCTG
  61 GTTCTTCAGG CTTCAGCCCC CTCCTTAGCC TGGGCTCTTC GTGGTGCTGA GGGACCTTCA
 121 GTCCGGATCC AGTGCCATCA TGACAAAGGA TTATCAAGAT TTCCAGCACC TGGACAATGA
 181 TAATGACCAT CATCAACTCC GGAGAGGGCC GCCTCCCACT CCACGGCTCT TGCAGCGACT
 241 CTGCTCTGGA TCCCGCCTCC TCCTGCTCTC CTCGAGCCTC AGCATTCTGT TGCTGGTGGT
 301 TGTCTGTGTG ATCACATCCC AAAATTCCCA ACTCCGGGAA GATCTGCTGG CTCTAAGGCA
 361 GAATTTCAGC AACCTCACTG TGAGCACTGA GGACCAGGTC AAGGCCCTGA GCACCCAGGG
 421 AAGTAGTGTG GGAAGAAAGA TGAAGTTAGT GGAGTCGAAG CTGGAAAAAC AGCAGAAGGA
 481 TCTGACTGAA GATCACTCCA GTTTGCTACT GCACGTGAAG CAGTTAGTGT CTGACGTGCG
 541 AAGCTTGAGC TGCCAGATGG CTGCATTTCG GGGCAATGGC TCTGAAAGGA CCTGCTGCCC
 601 CATCAACTGG GTGGAGTATG AAGGCAGCTG CTACTGGTTC TCCAGCTCTG TGAGGCCTTG
 661 GACTGAAGCT GACAAGTACT GCCAGCTGGA AAATGCCCAT CTGGTGGTGG TGACCTCCAG
 721 GGATGAGCAG AACTTCCTCC AGCGCCACAT GGGCCCCTTA AACACTTGGA TTGGCCTAAC
 781 TGACCAGAAC GGGCCCTGGA AATGGGTGGA TGGAACAGAC TACGAGACAG GCTTCCAGAA
 841 TTGGAGACCA GAGCAGCCAG ATAACTGGTA CGGACATGGG CTTGGAGGAG GCGAGGACTG
 901 TGCCCACTTC ACGACGGATG GCCGCTGGAA TGACGACGTC TGCAGGAGGC CCTACCGCTG
 961 GGTCTGTGAG ACAAAGTTGG ATAAGGCTAA TTAGGAACCT TCCTTCCCCT CATTTATATC
1021 CTTAATTCCT TGAGCTGCTG AGGTTTAGAA CTGGTAGAGC CTACCTAAGG GTCTCCCCAT
1081 CTCCAGGAAC TCTCATGTAG GATTTTTAAA GGACCGGTAA AGAATGGTGT TTGAGAAATG
1141 GTGTATGATG CCTGGTGGTG GTAGGGGTGC GTATTGAAAC CCAGCGCGCA GTTCTCTTCT
1201 GTCAGCTTGT TTTTTTTAGA GTAAAAGGAA GAGAAATAAA AGTTC (SEQ ID NO: 3011)
```

FIG. 2

```
1    CTGTCCACCT GGTTCTTCAG GCTTCAGCCC CCTCCTTAGC CTGGGCTCTT CGTGGTGCTG
61   AGGGACCTTC AGTCCTGCCC CAGTGCTATC ATGACAAAGG ATTATCAAGA TTTCCAGCAC
121  TTGGACAATG AGAACGACCA CCATCAACTC CAGAGAGGGC CACCTCCCGC TCCAAGGCTC
181  TTGCAGCGAC TCTGCTCTGG ATTCCGTCTC TTCCTGCTTT CCCTGGGCCT CAGCATCCTG
241  CTGCTGGTGG TTGTCTGTGT GATCACATCC CAAAATTCCC AACTCCGGGA AGATCTGCGG
301  GTTCTAAGGC AGAATTTCAG CAACTTTACC GTGAGCACTG AGGACCAGGT CAAGGCCCTG
361  ACCACCCAGG GAGAGAGAGT GGGAAGAAAG ATGAAGTTAG TCGAGTCACA GCTGGAAAAA
421  CATCAGGAGG ATCTGAGGGA AGACCACTCT AGATTGCTAC TGCATGTAAA GCAGTTAGTG
481  TCTGACGTGC GAAGCTTGAG CTGCCAGATG GCCGCACTTC GGGGCAATGG CTCTGAAAGG
541  ATCTGCTGCC CCATCAACTG GGTGGAGTAT GAAGGCAGCT GCTACTGGTT CTCCAGCTCT
601  GTGAAGCCTT GGACGGAAGC TGACAAGTAC TGCCAGCTGG AGAACGCCCA CCTGGTGGTG
661  GTGACTTCCT GGGAGGAGCA GAGATTCGTC CAGCAACACA TGGGCCCCTT AAATACTTGG
721  ATTGGCCTAA CTGACCAGAA CGGACCCTGG AAATGGGTGG ATGGGACAGA CTATGAGACA
781  GGCTTCAAGA ACTGGAGACC AGGGCAGCCA GATGACTGGT ACGGACATGG GCTTGGAGGG
841  GGTGAAGACT GTGCCCACTT CACCACCGAT GGCCACTGGA ATGATGACGT CTGCAGGAGG
901  CCCTACCGCT GGGTCTGTGA GACAGAGTTG GGCAAGGCCA ATTAGGAGCC TCCATTCCCC
961  TGATTTATTT CCTGAGTGCC TTGAGCTGTG AGGCTTAGAG TTGGGAGGTC CTACTCAAGG
1021 GTCTCCCCAT CTTTGGGAAC TTTCATCTAG GATTTTAAGG GGCTGGTAAA GAATGGTGTT
1081 TGAGGAATGT GGTATGATGC CTGGTGGTGG TGGTGGTGGT GGTTATTGGA ACCCATGACA
1141 CTTTGTGCAG TGTGCAGCTT ACTACTGCCA ACTTGTTTTT GAGAGTAAAA GAAGGAAGAT
1201 AAAC (SEQ ID NO: 3012)
```

FIG. 3

```
1    TTACTGTCCA AAGTCCCGGG CACTGGAGAT GCCACGTTTG GCGTGCTTGG ACACACAGAC
61   ACGCAGACAC AGAGACACCG GGGCCCAGGG CCCTCCTATG GACCCTGCCC GCTCCCACTC
121  CATCGTCCAC GGCTGTCCAC CCACCCCCAT TCTCCAAGCT TCAGCCCCCC TCCTTAGTCC
181  GGCATCTGCA CAGCACTGAA GAACCTGGGA GTCAGACCCT GAGACCCCGA GCAACTCTAG
241  TCCTCGTGAG CCCCCACCTC AGCCCAGCC TCAGCCTTGA CTCAGTCCCA GCTCCAGCAC
301  CAGCCCTATC ATGACCAAGG AGTATCAGGA CCTGCAGCAT CTGGACAATG AGGAGAGTGA
361  CCACCATCAG CTCGGAAAAG GCCACCTCC TCCGCAGTCC CTCCTGCGGC GTCTCTGCTC
421  CGGCCCTCGC CTCCTCCTGC TCTCCCTGGG CCTCAGCCTC CTGCTGCTGG TGGTTGTCTG
481  TGTGATCGGA TCCCAAAACG CCCAGCTGCA GCGGGAGCTG CGGGGCCTGA GAGAGACGCT
541  CAGCAACTTC ACAGCGAGCA CCGAGGCCCA GGTCAAGGGC TTGAGCACCC AGGGAGGCAA
601  TGTGGGAAGA AAGATGAAGT CGCTGGAGTC CCAGCTGGAG AAACAGCAGA AGGACTTGAG
661  TGAAGATCAC TCCAGCCTGC TGCTCCACGT GAAGCAGTTC GTGTCTGACC TGCGGAGCCT
721  GAGCTGTCAG ATGGCGGCGC TCCAGGGCAA TGGCTCGGAA AGGGCCTGCT GCCCAGTCAA
781  CTGGGTGGAG CACGAGCGCA GCTGCTACTG GTTCTCTCGC TCCGGGAAGG CCTGGGCCGA
841  CGCCGACAAC TACTGCCGGC TGGAGGACGC GCACCTGGTG GTGGTCACGT CCTGGGAGGA
901  GCAGAAATTT GTCCAGCACC ACATAGGTCC TGTGAACACC TGGATGGGCC TCCACGACCA
961  AAACGGGCCC TGGAAGTGGG TGGACGGGAC GGACTACGAG ACGGGCTTCA GAACTGGAG
1021 ACCGGAGCAG CCGGACGACT GGTACGGCCA CGGGCTCGGG GGAGGGGAGG ACTGTGCCCA
1081 CTTCACCGAC GACGGCCGCT GGAACGACGA CGTCTGCCAG AGGCCCTACC GCTGGGTCTG
1141 CGAGACAGAG CTGGACAAGG CCAGTCAGGA GCCACCTCTC CTTTAATTTA TTTCTTCAGT
1201 GCCTCGACCT GCCGCAGGGG TCCGGGGTTG GGAATCCGCC CGTCTGGGGG CCTCTTCTGC
1261 TTTCTCGGGG ATTTTCATGT AGGATTTTAA GGGAAGGGGA AGGATAGGAT GATGTTGGGA
1321 AGGTGGGGGA CTTGAAACCC GTGGCGCTTT CTGTAGTTTG CACGTTATCA TTGTCAACTT
1381 TTTTTTTTTT TTAGAGTAAA AAGAAATATA CCTAAAC (SEQ ID NO: 3013)
```

FIG. 4

RNAI CONSTRUCTS FOR INHIBITING ASGR1 EXPRESSION AND METHODS OF USE THEREOF

CROSS-REFERENCE TO RELATED APPLICATIONS

This application claims the benefit of U.S. Provisional Application No. 62/380,216, filed Aug. 26, 2016, which is hereby incorporated by reference in its entirety.

DESCRIPTION OF THE TEXT FILE SUBMITTED ELECTRONICALLY

The present application contains a Sequence Listing, which has been submitted electronically in ASCII format and is hereby incorporated by reference in its entirety. The computer readable format copy of the Sequence Listing, which was created on Jun. 24, 2019, is named A-2094-US-PCT SubSeq ST25 and is 1.50 megabytes in size.

FIELD OF THE INVENTION

The present invention relates to compositions and methods for modulating liver expression of asialoglycoprotein receptor 1 (ASGR1). In particular, the present invention relates to nucleic acid-based therapeutics for reducing ASGR1 expression via RNA interference and methods of using such nucleic acid-based therapeutics to treat or prevent cardiovascular disease.

BACKGROUND OF THE INVENTION

Despite the many advancements and new therapeutics that have emerged over the last several years, cardiovascular disease remains the leading cause of death worldwide. One out of every three adults in America has some form of cardiovascular disease, including coronary artery disease, myocardial infarction, angina, heart failure, and stroke (Heart disease and stroke statistics-2016 update: a report from the American Heart Association. Circulation, Vol. 133:e38-e360, 2016). In 2013, over 17.3 million people globally and 1.4 million people in the United States died from some form of cardiovascular disease, accounting for 31% of all global deaths and 54% of all deaths in the U.S. that year (Heart disease and stroke statistics-2016 update). Cardiovascular disease currently claims more lives each year than the next two leading causes of death, cancer and chronic lower respiratory disease, combined (Heart disease and stroke statistics-2016 update). Thus, there remains a need for additional therapeutic agents for the treatment of cardiovascular disease.

The asialoglycoprotein receptor is a calcium-dependent receptor expressed on the surface of hepatocytes that contributes to the removal and degradation of desialylated glycoproteins from the serum by binding to ligands with terminal galactose and N-acetylgalactosamine residues (Weigel, Bioessays, Vol. 16:519-524, 1994; Stockert, Physiol. Rev., Vol. 75: 591-609, 1995). The hetero-oligomeric asialoglycoprotein receptor is comprised of two different proteins, a 48 kDa asialoglycoprotein receptor 1 (ASGR1) major subunit and a 40 kDa asialoglycoprotein receptor 2 (ASGR2) minor subunit (see, e.g., Stockert, 1995). The asialogylcoprotein receptor has been implicated in the clearance of low density lipoproteins and chylomicron remnants, suggesting a role for the receptor in lipoprotein metabolism (Windler et al., Biochem J., Vol. 276 (Pt 1):79-87, 1991; Ishibashi et al., J Biol Chem., Vol. 271:22422-22427, 1996). Recently, human carriers of loss of function variant alleles of the ASGR1 subunit of the asialoglycoprotein receptor were reported to have lower serum levels of non-high-density lipoprotein (HDL) cholesterol and a lower risk of coronary artery disease and myocardial infarction as compared to non-carriers (Nioi et al., New England Journal of Medicine, Vol. 374(22):2131-2141, 2016). Accordingly, therapeutics targeting ASGR1 function represent a novel approach to reducing non-HDL cholesterol levels and treating cardiovascular disease, particularly coronary artery disease.

SUMMARY OF THE INVENTION

The present invention is based, in part, on the design and generation of RNAi constructs that target the ASGR1 gene and reduce expression of ASGR1 in liver cells. The sequence-specific inhibition of ASGR1 expression is useful for treating or preventing conditions associated with ASGR1 expression, such as cardiovascular disease. Accordingly, in one embodiment, the present invention provides an RNAi construct comprising a sense strand and an antisense strand, wherein the antisense strand comprises a region having a sequence that is complementary to an ASGR1 mRNA sequence. In certain embodiments, the antisense strand comprises a region having at least 15 contiguous nucleotides from an antisense sequence listed in Table 1, Table 6, or Table 8.

In some embodiments, the sense strand of the RNAi constructs described herein comprises a sequence that is sufficiently complementary to the sequence of the antisense strand to form a duplex region of about 15 to about 30 base pairs in length. In these and other embodiments, the sense and antisense strands each are about 15 to about 30 nucleotides in length. In some embodiments, the RNAi constructs comprise at least one blunt end. In other embodiments, the RNAi constructs comprise at least one nucleotide overhang. Such nucleotide overhangs may comprise 1 to 6 unpaired nucleotides and can be located at the 3' end of the sense strand, the 3' end of the antisense strand, or the 3' end of both the sense and antisense strand. In certain embodiments, the RNAi constructs comprise an overhang of two unpaired nucleotides at the 3' end of the sense strand and the 3' end of the antisense strand. In other embodiments, the RNAi constructs comprise an overhang of two unpaired nucleotides at the 3' end of the antisense strand and a blunt end of the 3' end of the sense strand/5' end of the antisense strand.

The RNAi constructs of the invention may comprise one or more modified nucleotides, including nucleotides having modifications to the ribose ring, nucleobase, or phosphodiester backbone. In some embodiments, the RNAi constructs comprise one or more 2'-modified nucleotides. Such 2'-modified nucleotides can include 2'-fluoro modified nucleotides, 2'-O-methyl modified nucleotides, 2'-O-methoxyethyl modified nucleotides, 2'-O-allyl modified nucleotides, bicyclic nucleic acids (BNA), or combinations thereof. In one particular embodiment, the RNAi constructs comprise one or more 2'-fluoro modified nucleotides, 2'-O-methyl modified nucleotides, or combinations thereof. In some embodiments, all of the nucleotides in the sense and antisense strand of the RNAi construct are modified nucleotides.

In some embodiments, the RNAi constructs comprise at least one backbone modification, such as a modified internucleotide or internucleoside linkage. In certain embodiments, the RNAi constructs described herein comprise at least one phosphorothioate internucleotide linkage. In particular embodiments, the phosphorothioate internucleotide linkages may be positioned at the 3' or 5' ends of the sense and/or antisense strands.

In some embodiments, the antisense strand and/or the sense strand of the RNAi constructs of the invention may comprise or consist of a sequence from the antisense and sense sequences listed in Tables 1, 6, or 8. In certain embodiments, the RNAi construct may be any one of the duplex compounds listed in any one of Tables 1 to 10. In one embodiment, the RNAi construct is D-1098, D-1176, D-1200, D-1206, D-1235, D-1246, D-1373, D-1389, D-1813, D-1815, D-1983, D-2000, D-2045, D-2142, D-2143, D-1438, D-1494, D-2357, D-2359, D-2361, D-2365, D-2461, D-3036, D-3037, D-3051, D-3053, D-3057, D-3779, D-3780, D-3782, D-3788, D-3791, D-3795, D-3799, or D-3800. In another embodiment, the RNAi construct is D-1200, D-1206, D-1235, D-1815, D-2143, D-2359, D-2361, D-2365, D-2142, D-1176, D-3779, D-3782, D-3788, D-3799, or D-3800. In another embodiment, the RNAi construct is D-2359. In another embodiment, the RNAi construct is D-1815. In yet another embodiment, the RNAi construct is D-1235. In still another embodiment, the RNAi construct is D-2143. In another embodiment, the RNAi construct is D-2361. In some embodiments, the RNAi construct is D-3782. In other embodiments, the RNAi construct is D-3799.

The RNAi constructs may further comprise a ligand to facilitate delivery or uptake of the RNAi constructs to specific tissues or cells, such as liver cells. In certain embodiments, the ligand targets delivery of the RNAi constructs to hepatocytes. In these and other embodiments, the ligand may comprise galactose, galactosamine, or N-acetyl-galactosamine (GalNAc). In certain embodiments, the ligand comprises a multivalent galactose or multivalent GalNAc moiety, such as a trivalent or tetravalent galactose or GalNAc moiety. The ligand may be covalently attached to the 5' or 3' end of the sense strand of the RNAi construct, optionally through a linker. In some embodiments, the RNAi constructs comprise a ligand and linker having a structure according to any of Formulas I to XXIX described herein. In certain embodiments, the RNAi constructs comprise a ligand and linker having a structure according to Formula VII, Formula VIII, Formula XVI, Formula XXVI, or Formula XXIX. In one embodiment, the RNAi constructs comprise a ligand and linker having a structure according to Formula XVI, wherein n=1 and k=3.

In certain embodiments, the ligand may comprise an antibody or antigen-binding fragment thereof that specifically binds to ASGR1. The 5' or 3' end of the sense strand of the RNAi construct may be covalently linked to the antibody or antigen-binding fragment through the side chain of an amino acid residue in the light chain or heavy chain of the antibody or antigen-binding fragment. In some embodiments, the sense strand of the RNAi construct is covalently attached, optionally through a linker, to the side chain of a cysteine residue present in the heavy chain or light chain of the antibody or antigen-binding fragment thereof. In one embodiment, the anti-ASGR1 antibody-RNA molecule conjugate comprises at least one copy of the interfering RNA molecule (e.g. siRNA or shRNA). In another embodiment, the anti-ASGR1 antibody-RNA molecule conjugate comprises two copies of the interfering RNA molecule (e.g. siRNA or shRNA).

The present invention also provides pharmaceutical compositions comprising any of the RNAi constructs described herein and a pharmaceutically acceptable carrier, excipient, or diluent. Such pharmaceutical compositions are particularly useful for reducing expression of ASGR1 in the cells (e.g. liver cells) of a patient in need thereof. Patients who may be administered a pharmaceutical composition of the invention can include patients with a history of myocardial infarction, patients diagnosed with or at risk for coronary artery disease or other form of cardiovascular disease, and patients with elevated levels of non-HDL cholesterol. Accordingly, the present invention includes methods of treating or preventing cardiovascular disease in a patient in need thereof by administering an RNAi construct or pharmaceutical composition described herein. In certain embodiments, the present invention provides methods for reducing non-HDL cholesterol in a patient in need thereof by administering an RNAi construct or pharmaceutical composition described herein.

The use of ASGR1-targeting RNAi constructs in any of the methods described herein or for preparation of medicaments for administration according to the methods described herein is specifically contemplated. For instance, the present invention includes an ASGR1-targeting RNAi construct for use in a method for treating or preventing cardiovascular disease, including coronary artery disease or myocardial infarction, in a patient in need thereof. The present invention also includes an ASGR1-targeting RNAi construct for use in a method for reducing non-HDL cholesterol in a patient in need thereof. In some embodiments, the present invention provides an ASGR1-targeting RNAi construct for use in a method for reducing the risk of myocardial infarction in a patient in need thereof.

The present invention also encompasses the use of an ASGR1-targeting RNAi construct in the preparation of a medicament for treating or preventing cardiovascular disease, including coronary artery disease or myocardial infarction, in a patient in need thereof. In certain embodiments, the present invention provides the use of an ASGR1-targeting RNAi construct in the preparation of a medicament for reducing non-HDL cholesterol in a patient in need thereof. In certain other embodiments, the present invention provides the use of an ASGR1-targeting RNAi construct in the preparation of a medicament for reducing the risk of myocardial infarction in a patient in need thereof.

BRIEF DESCRIPTION OF THE DRAWINGS

FIG. 1A shows the nucleotide sequence of transcript variant 1 of human ASGR1 (NCBI Reference Sequence No. NM_001671.4; SEQ ID NO: 1). The transcript sequence is depicted as the complementary DNA (cDNA) sequence with thymine bases replacing uracil bases.

FIG. 1B shows the nucleotide sequence of transcript variant 2 of human ASGR1 (NCBI Reference Sequence No. NM_001197216.2; SEQ ID NO: 2). The transcript sequence is depicted as the cDNA sequence with thymine bases replacing uracil bases.

FIG. 2 shows the nucleotide sequence of transcript variant 1 of mouse Asgr1 (NCBI Reference Sequence No. NM_009714.2; SEQ ID NO: 3011). The transcript sequence is depicted as the complementary DNA (cDNA) sequence with thymine bases replacing uracil bases.

FIG. 3 shows the nucleotide sequence of a transcript of rat Asgr1 (SEQ ID NO: 3012). The transcript sequence is depicted as the complementary DNA (cDNA) sequence with thymine bases replacing uracil bases.

FIG. 4 shows the nucleotide sequence of a transcript of macaque (*Macaca fascicularis*) ASGR1 (NCBI Reference Sequence No. XM_005582698.1; SEQ ID NO: 3013). The transcript sequence is depicted as the complementary DNA (cDNA) sequence with thymine bases replacing uracil bases.

DETAILED DESCRIPTION

Figure 5:
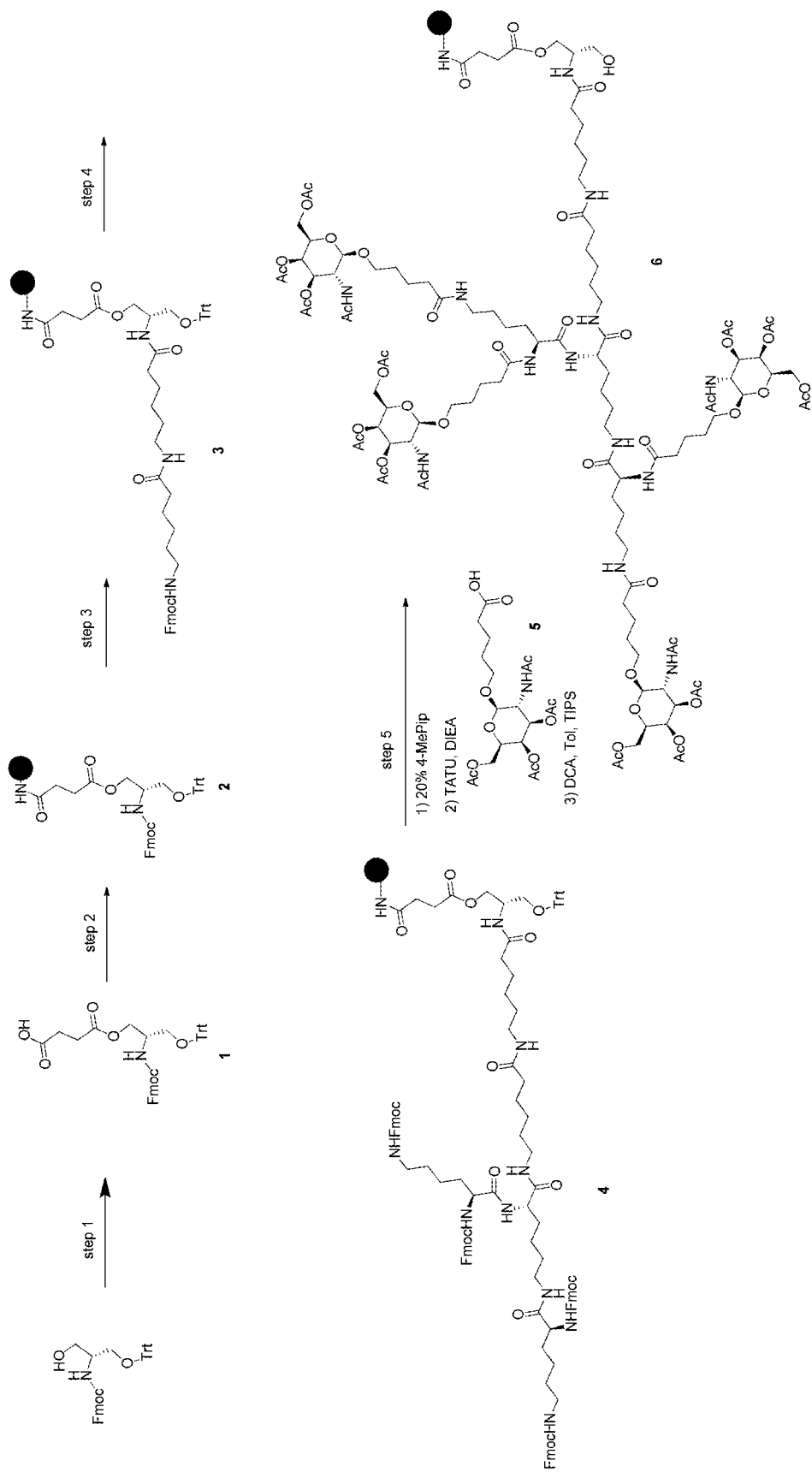
FIG. 5 depicts the synthetic scheme for a tetravalent GalNAc moiety that can be incorporated into any of the RNAi constructs of the invention.

The present invention is directed to compositions and methods for regulating the expression of the asialoglycoprotein receptor in a cell or mammal. In some embodiments, compositions of the invention comprise RNAi constructs that target an ASGR1 mRNA and reduce ASGR1 expression in a cell or mammal. Such RNAi constructs are useful for treating or preventing various forms of cardiovascular disease, such as, for example, by reducing non-HDL cholesterol serum levels and reducing the risk of developing coronary artery disease or myocardial infarction.

As used herein, the term "RNAi construct" refers to an agent comprising a RNA molecule that is capable of down-regulating expression of a target gene (e.g. ASGR1) via a RNA interference mechanism when introduced into a cell. RNA interference is the process by which a nucleic acid molecule induces the cleavage and degradation of a target RNA molecule (e.g. messenger RNA or mRNA molecule) in a sequence-specific manner, e.g. through a RNA-induced silencing complex (RISC) pathway. In some embodiments, the RNAi construct comprises a double-stranded RNA molecule comprising two antiparallel strands of contiguous nucleotides that are sufficiently complementary to each other to hybridize to form a duplex region. "Hybridize" or "hybridization" refers to the pairing of complementary polynucleotides, typically via hydrogen bonding (e.g. Watson-Crick, Hoogsteen or reversed Hoogsteen hydrogen bonding) between complementary bases in the two polynucleotides. The strand comprising a region having a sequence that is substantially complementary to a target sequence (e.g. target mRNA) is referred to as the "antisense strand." The "sense strand" refers to the strand that includes a region that is substantially complementary to a region of the antisense strand. In some embodiments, the sense strand may comprise a region that has a sequence that is substantially identical to the target sequence.

A double-stranded RNA molecule may include chemical modifications to ribonucleotides, including modifications to the ribose sugar, base, or backbone components of the ribonucleotides, such as those described herein or known in the art. Any such modifications, as used in a double-stranded RNA molecule (e.g. siRNA, shRNA, or the like), are encompassed by the term "double-stranded RNA" for the purposes of this disclosure.

As used herein, a first sequence is "complementary" to a second sequence if a polynucleotide comprising the first sequence can hybridize to a polynucleotide comprising the second sequence to form a duplex region under certain conditions, such as physiological conditions. Other such conditions can include moderate or stringent hybridization conditions, which are known to those of skill in the art. A first sequence is considered to be fully complementary (100% complementary) to a second sequence if a polynucleotide comprising the first sequence base pairs with a polynucleotide comprising the second sequence over the entire length of one or both nucleotide sequences without any mismatches. A sequence is "substantially complementary" to a target sequence if the sequence is at least about 80%, 85%, 90%, 95%, 96%, 97%, 98%, or 99% complementary to a target sequence. Percent complementarity can be calculated by dividing the number of bases in a first sequence that are complementary to bases at corresponding positions in a second or target sequence by the total length of the first sequence. A sequence may also be said to be substantially complementary to another sequence if there are no more than 5, 4, 3, or 2 mismatches over a 30 base pair duplex region when the two sequences are hybridized. Generally, if any nucleotide overhangs, as defined herein, are present, the sequence of such overhangs is not considered in determining the degree of complementarity between two sequences. By way of example, a sense strand of 21 nucleotides in length and an antisense strand of 21 nucleotides in length that hybridize to form a 19 base pair duplex region with a 2 nucleotide overhang at the 3' end of each strand would be considered to be fully complementary as the term is used herein.

In some embodiments, a region of the antisense strand comprises a sequence that is fully complementary to a region of the target RNA sequence (e.g. ASGR1 mRNA). In such embodiments, the sense strand may comprise a sequence that is fully complementary to the sequence of the antisense strand. In other such embodiments, the sense strand may comprise a sequence that is substantially complementary to the sequence of the antisense strand, e.g. having 1, 2, 3, 4, or 5 mismatches in the duplex region formed by the sense and antisense strands. In certain embodiments, it is preferred that any mismatches occur within the terminal regions (e.g. within 6, 5, 4, 3, or 2 nucleotides of the 5' and/or 3' ends of the strands). In one embodiment, any mismatches in the duplex region formed from the sense and antisense strands occur within 6, 5, 4, 3, or 2 nucleotides of the 5' end of the antisense strand.

In certain embodiments, the sense strand and antisense strand of the double-stranded RNA may be two separate molecules that hybridize to form a duplex region, but are otherwise unconnected. Such double-stranded RNA molecules formed from two separate strands are referred to as "small interfering RNAs" or "short interfering RNAs" (siRNAs). Thus, in some embodiments, the RNAi constructs of the invention comprise a siRNA.

In other embodiments, the sense strand and the antisense strand that hybridize to form a duplex region may be part of a single RNA molecule, i.e. the sense and antisense strands are part of a self-complementary region of a single RNA molecule. In such cases, a single RNA molecule comprises a duplex region (also referred to as a stem region) and a loop region. The 3' end of the sense strand is connected to the 5' end of the antisense strand by a contiguous sequence of unpaired nucleotides, which will form the loop region. The loop region is typically of a sufficient length to allow the RNA molecule to fold back on itself such that the antisense strand can base pair with the sense strand to form the duplex or stem region. The loop region can comprise from about 3 to about 25, from about 5 to about 15, or from about 8 to about 12 unpaired nucleotides. Such RNA molecules with at least partially self-complementary regions are referred to as "short hairpin RNAs" (shRNAs). In certain embodiments, the RNAi constructs of the invention comprise a shRNA. The length of a single, at least partially self-complementary RNA molecule can be from about 35 nucleotides to about 100 nucleotides, from about 45 nucleotides to about 85 nucleotides, or from about 50 to about 60 nucleotides and comprise a duplex region and loop region each having the lengths recited herein.

In some embodiments, the RNAi constructs of the invention comprise a sense strand and an antisense strand, wherein the antisense strand comprises a region having a sequence that is substantially or fully complementary to an ASGR1 messenger RNA (mRNA) sequence. As used herein, an "ASGR1 mRNA sequence" refers to any messenger RNA sequence, including splice variants, encoding an ASGR1 protein, including ASGR1 protein variants or isoforms from any species (e.g. mouse, rat, non-human primate, human). ASGR1 protein (also known as HL-1, ASGPR H1, ASGPR1, and CLEC4H1), as used herein, refers to the major subunit of the asialoglycoprotein receptor. In humans, ASGR1 is found on chromosome 17p13.2 and is expressed as two different isoforms, a long isoform (H1a or isoform A) of about 291 amino acids and a short soluble isoform (H1b or isoform B) of about 252 amino acids.

An ASGR1 mRNA sequence also includes the transcript sequence expressed as its complementary DNA (cDNA) sequence. A cDNA sequence refers to the sequence of an mRNA transcript expressed as DNA bases (e.g. guanine, adenine, thymine, and cytosine) rather than RNA bases (e.g. guanine, adenine, uracil, and cytosine). Thus, the antisense strand of the RNAi constructs of the invention may comprise a region having a sequence that is substantially or fully complementary to a target ASGR1 mRNA sequence or ASGR1 cDNA sequence. An ASGR1 mRNA or cDNA sequence can include, but is not limited to, any ASGR1 mRNA or cDNA sequence selected from the NCBI Reference sequences NM_001671.4 (human; FIG. 1A, SEQ ID NO: 1), NM_001197216.2 (human; FIG. 1B, SEQ ID NO: 2), NM_009714.2 (mouse; FIG. 2, SEQ ID NO: 3011), and XM_055582698.1 (cynomolgus monkey; FIG. 4, SEQ ID NO: 3013) or the rat sequence in FIG. 3 (SEQ ID NO: 3012). In one embodiment, the ASGR1 mRNA sequence is human transcript variant 1 listed in the NCBI database as Reference Sequence NM_001671.4 (see FIG. 1A; SEQ ID NO: 1). In another embodiment, the ASGR1 mRNA sequence is human transcript variant 2 listed in the NCBI database as Reference Sequence NM_001197216.2 (see FIG. 1B; SEQ ID NO: 2).

A region of the antisense strand can be substantially complementary or fully complementary to at least 15 consecutive nucleotides of the ASGR1 mRNA sequence. In some embodiments, the target region of the ASGR1 mRNA sequence to which the antisense strand comprises a region of complementarity can range from about 15 to about 30 consecutive nucleotides, from about 16 to about 28 consecutive nucleotides, from about 18 to about 26 consecutive nucleotides, from about 17 to about 24 consecutive nucleotides, from about 19 to about 25 consecutive nucleotides, from about 19 to about 23 consecutive nucleotides, or from about 19 to about 21 consecutive nucleotides. In certain embodiments, the region of the antisense strand comprising a sequence that is substantially or fully complementary to an ASGR1 mRNA sequence may, in some embodiments, comprise at least 15 contiguous nucleotides from an antisense sequence listed in Table 1, Table 6, or Table 8. In other embodiments, the antisense sequence comprises at least 16, at least 17, at least 18, or at least 19 contiguous nucleotides from an antisense sequence listed in Table 1, Table 6, or Table 8. For instance, in some embodiments, the region of the antisense strand comprising a sequence that is substantially or fully complementary to an ASGR1 mRNA sequence comprises at least 15 contiguous nucleotides from a sequence selected from SEQ ID NO: 1606, SEQ ID NO: 1684, SEQ ID NO: 1708, SEQ ID NO: 1714, SEQ ID NO: 1743, SEQ ID NO: 1754, SEQ ID NO: 1881, SEQ ID NO: 1897, SEQ ID NO: 2321, SEQ ID NO: 2323, SEQ ID NO: 2491, SEQ ID NO: 2508, SEQ ID NO: 2553, SEQ ID NO: 2650, SEQ ID NO: 2651, SEQ ID NO: 1946, SEQ ID NO: 2002, SEQ ID NO: 2865, SEQ ID NO: 2867, SEQ ID NO: 2869, SEQ ID NO: 2873, SEQ ID NO: 2969, SEQ ID NO: 3701, SEQ ID NO: 3702, SEQ ID NO: 3716, SEQ ID NO: 3718, SEQ ID NO: 3722, SEQ ID NO: 4618, SEQ ID NO: 4619, SEQ ID NO: 4621, SEQ ID NO: 4627, SEQ ID NO: 4630, SEQ ID NO: 4634, SEQ ID NO: 4638, or SEQ ID NO: 4639.

The sense strand of the RNAi construct typically comprises a sequence that is sufficiently complementary to the sequence of the antisense strand such that the two strands hybridize under physiological conditions to form a duplex region. A "duplex region" refers to the region in two complementary or substantially complementary polynucleotides that form base pairs with one another, either by Watson-Crick base pairing or other hydrogen bonding interaction, to create a duplex between the two polynucleotides. The duplex region of the RNAi construct should be of sufficient length to allow the RNAi construct to enter the RNA interference pathway, e.g. by engaging the Dicer enzyme and/or the RISC complex. For instance, in some embodiments, the duplex region is about 15 to about 30 base pairs in length. Other lengths for the duplex region within this range are also suitable, such as about 15 to about 28 base pairs, about 15 to about 26 base pairs, about 15 to about 24 base pairs, about 15 to about 22 base pairs, about 17 to about 28 base pairs, about 17 to about 26 base pairs, about 17 to about 24 base pairs, about 17 to about 23 base pairs, about 17 to about 21 base pairs, about 19 to about 25 base pairs, about 19 to about 23 base pairs, or about 19 to about 21 base pairs. In one embodiment, the duplex region is about 17 to about 24 base pairs in length. In another embodiment, the duplex region is about 19 to about 21 base pairs in length.

For embodiments in which the sense strand and antisense strand are two separate molecules (e.g. RNAi construct comprises a siRNA), the sense strand and antisense strand need not be the same length as the length of the duplex region. For instance, one or both strands may be longer than the duplex region and have one or more unpaired nucleotides or mismatches flanking the duplex region. Thus, in some embodiments, the RNAi construct comprises at least one nucleotide overhang. As used herein, a "nucleotide overhang" refers to the unpaired nucleotide or nucleotides that extend beyond the duplex region at the terminal ends of the strands. Nucleotide overhangs are typically created when the 3' end of one strand extends beyond the 5' end of the other strand or when the 5' end of one strand extends beyond the 3' end of the other strand. The length of a nucleotide overhang is generally between 1 and 6 nucleotides, 1 and 5 nucleotides, 1 and 4 nucleotides, 1 and 3 nucleotides, 2 and 6 nucleotides, 2 and 5 nucleotides, or 2 and 4 nucleotides. In some embodiments, the nucleotide overhang comprises 1, 2, 3, 4, 5, or 6 nucleotides. In one particular embodiment, the nucleotide overhang comprises 1 to 4 nucleotides. In certain embodiments, the nucleotide overhang comprises 2 nucleotides. The nucleotides in the overhang can be ribonucleotides, deoxyribonucleotides, or modified nucleotides as described herein. In some embodiments, the overhang comprises a 5'-uridine-uridine-3' (5'-UU-3') dinucleotide. In such embodiments, the UU dinucleotide may comprise ribonucleotides or modified nucleotides, e.g. 2'-modified nucleotides. In other embodiments, the overhang comprises a 5'-deoxythymidine-deoxythymidine-3' (5'-dTdT-3') dinucleotide.

The nucleotide overhang can be at the 5' end or 3' end of one or both strands. For example, in one embodiment, the RNAi construct comprises a nucleotide overhang at the 5' end and the 3' end of the antisense strand. In another embodiment, the RNAi construct comprises a nucleotide overhang at the 5' end and the 3' end of the sense strand. In some embodiments, the RNAi construct comprises a nucleotide overhang at the 5' end of the sense strand and the 5' end of the antisense strand. In other embodiments, the RNAi construct comprises a nucleotide overhang at the 3' end of the sense strand and the 3' end of the antisense strand.

The RNAi constructs may comprise a single nucleotide overhang at one end of the double-stranded RNA molecule and a blunt end at the other. A "blunt end" means that the sense strand and antisense strand are fully base-paired at the end of the molecule and there are no unpaired nucleotides that extend beyond the duplex region. In some embodiments, the RNAi construct comprises a nucleotide overhang at the 3' end of the sense strand and a blunt end at the 5' end of the sense strand and 3' end of the antisense strand. In other embodiments, the RNAi construct comprises a nucleotide overhang at the 3' end of the antisense strand and a blunt end at the 5' end of the antisense strand and the 3' end of the sense strand. In certain embodiments, the RNAi construct comprises a blunt end at both ends of the double-stranded RNA molecule. In such embodiments, the sense strand and antisense strand have the same length and the duplex region is the same length as the sense and antisense strands (i.e. the molecule is double-stranded over its entire length).

The sense strand and antisense strand can each independently be about 15 to about 30 nucleotides in length, about 18 to about 28 nucleotides in length, about 19 to about 27 nucleotides in length, about 19 to about 25 nucleotides in length, about 19 to about 23 nucleotides in length, about 21 to about 25 nucleotides in length, or about 21 to about 23 nucleotides in length. In certain embodiments, the sense strand and antisense strand are each about 18, about 19, about 20, about 21, about 22, about 23, about 24, or about 25 nucleotides in length. In some embodiments, the sense strand and antisense strand have the same length but form a duplex region that is shorter than the strands such that the RNAi construct has two nucleotide overhangs. For instance, in one embodiment, the RNAi construct comprises (i) a sense strand and an antisense strand that are each 21 nucleotides in length, (ii) a duplex region that is 19 base pairs in length, and (iii) nucleotide overhangs of 2 unpaired nucleotides at both the 3' end of the sense strand and the 3' end of the antisense strand. In another embodiment, the RNAi construct comprises (i) a sense strand and an antisense strand that are each 23 nucleotides in length, (ii) a duplex region that is 21 base pairs in length, and (iii) nucleotide overhangs of 2 unpaired nucleotides at both the 3' end of the sense strand and the 3' end of the antisense strand. In other embodiments, the sense strand and antisense strand have the same length and form a duplex region over their entire length such that there are no nucleotide overhangs on either end of the double-stranded molecule. In one such embodiment, the RNAi construct is blunt ended and comprises (i) a sense strand and an antisense strand, each of which is 21 nucleotides in length, and (ii) a duplex region that is 21 base pairs in length. In another such embodiment, the RNAi construct is blunt ended and comprises (i) a sense strand and an antisense strand, each of which is 23 nucleotides in length, and (ii) a duplex region that is 23 base pairs in length.

In other embodiments, the sense strand or the antisense strand is longer than the other strand and the two strands form a duplex region having a length equal to that of the shorter strand such that the RNAi construct comprises at least one nucleotide overhang. For example, in one embodiment, the RNAi construct comprises (i) a sense strand that is 19 nucleotides in length, (ii) an antisense strand that is 21 nucleotides in length, (iii) a duplex region of 19 base pairs in length, and (iv) a single nucleotide overhang of 2 unpaired nucleotides at the 3' end of the antisense strand. In another embodiment, the RNAi construct comprises (i) a sense strand that is 21 nucleotides in length, (ii) an antisense strand that is 23 nucleotides in length, (iii) a duplex region of 21 base pairs in length, and (iv) a single nucleotide overhang of 2 unpaired nucleotides at the 3' end of the antisense strand.

The antisense strand of the RNAi constructs of the invention can comprise the sequence of any one of the antisense sequences listed in Table 1, Table 6, or Table 8, the sequence of nucleotides 1-19 of any of these antisense sequences, or the sequence of nucleotides 2-19 of any of these antisense sequences. Each of the antisense sequences listed in Tables 1, 6, and 8 comprises a sequence of at least 19 consecutive nucleotides (first 19 nucleotides counting from the 5' end) that is complementary to an ASGR1 mRNA sequence plus a two nucleotide overhang sequence. Thus, in some embodiments, the antisense strand comprises a sequence of nucleotides 1-19 of any one of SEQ ID NOs:

1508-3010, 3665-4315, or 4513-4687. In other embodiments, the antisense strand comprises a sequence of nucleotides 2-19 of any one of SEQ ID NOs: 1508-3010, 3665-4315, or 4513-4687. In still other embodiments, the antisense strand comprises a sequence selected from SEQ ID NOs: 1508-3010, 3665-4315, or 4513-4687. In certain embodiments, the antisense strand comprises, or consists of, a sequence selected from SEQ ID NO: 1606, SEQ ID NO: 1684, SEQ ID NO: 1708, SEQ ID NO: 1714, SEQ ID NO: 1743, SEQ ID NO: 1754, SEQ ID NO: 1881, SEQ ID NO: 1897, SEQ ID NO: 2321, SEQ ID NO: 2323, SEQ ID NO: 2491, SEQ ID NO: 2508, SEQ ID NO: 2553, SEQ ID NO: 2650, SEQ ID NO: 2651, SEQ ID NO: 1946, SEQ ID NO: 2002, SEQ ID NO: 2865, SEQ ID NO: 2867, SEQ ID NO: 2869, SEQ ID NO: 2873, SEQ ID NO: 2969, SEQ ID NO: 3701, SEQ ID NO: 3702, SEQ ID NO: 3716, SEQ ID NO: 3718, SEQ ID NO: 3722, SEQ ID NO: 4618, SEQ ID NO: 4619, SEQ ID NO: 4621, SEQ ID NO: 4627, SEQ ID NO: 4630, SEQ ID NO: 4634, SEQ ID NO: 4638, or SEQ ID NO: 4639. In some embodiments, the antisense strand comprises, or consists of, a sequence selected from SEQ ID NO: 1684, SEQ ID NO: 1708, SEQ ID NO: 1714, SEQ ID NO: 1743, SEQ ID NO: 2323, SEQ ID NO: 2650, SEQ ID NO: 2651, SEQ ID NO: 2867, SEQ ID NO: 2869, SEQ ID NO: 2873, SEQ ID NO: 4618, SEQ ID NO: 4621, SEQ ID NO: 4627, SEQ ID NO: 4638, or SEQ ID NO: 4639. In other embodiments, the antisense strand comprises, or consists of, a sequence selected from SEQ ID NO: 1743, SEQ ID NO: 2323, SEQ ID NO: 2651, SEQ ID NO: 2867, SEQ ID NO: 2869, SEQ ID NO: 4621, or SEQ ID NO: 4638.

In these and other embodiments, the sense strand of the RNAi constructs of the invention can comprise the sequence of any one of the sense sequences listed in Table 1, Table 6, or Table 8, the sequence of nucleotides 1-19 of any of these sense sequences, or the sequence of nucleotides 2-19 of any of these sense sequences. Each of the sense sequences listed in Tables 1, 6, and 8 comprises a sequence of at least 19 consecutive nucleotides (first 19 nucleotides counting from the 5' end) that is identical to an ASGR1 mRNA sequence and complementary to the corresponding antisense sequence, plus a two nucleotide overhang sequence. Thus, in some embodiments, the sense strand comprises a sequence of nucleotides 1-19 of any one of SEQ ID NOs: 5-1507, 3014-3664, or 4319-4512. In other embodiments, the sense strand comprises a sequence of nucleotides 2-19 of any one of SEQ ID NOs: 5-1507, 3014-3664, or 4319-4512. In still other embodiments, the sense strand comprises a sequence selected from SEQ ID NOs: 5-1507, 3014-3664, or 4319-4512. In certain embodiments, the sense strand comprises, or consists of, a sequence selected from SEQ ID NO: 103, SEQ ID NO: 181, SEQ ID NO: 205, SEQ ID NO: 211, SEQ ID NO: 240, SEQ ID NO: 251, SEQ ID NO: 378, SEQ ID NO: 394, SEQ ID NO: 818, SEQ ID NO: 820, SEQ ID NO: 988, SEQ ID NO: 1005, SEQ ID NO: 1050, SEQ ID NO: 1147, SEQ ID NO: 1148, SEQ ID NO: 443, SEQ ID NO: 499, SEQ ID NO: 1362, SEQ ID NO 1364, SEQ ID NO: 1366, SEQ ID NO: 1370, SEQ ID NO: 1466, SEQ ID NO: 3050, SEQ ID NO: 3051, SEQ ID NO: 3065, SEQ ID NO: 3067, SEQ ID NO: 3071, SEQ ID NO: 4443, SEQ ID NO: 4444, SEQ ID NO: 4446, SEQ ID NO: 4452, SEQ ID NO: 4455, SEQ ID NO: 4459, SEQ ID NO: 4463, or SEQ ID NO: 4464. In certain other embodiments, the sense strand comprises, or consists of, a sequence selected from SEQ ID NO: 181, SEQ ID NO: 205, SEQ ID NO: 211, SEQ ID NO: 240, SEQ ID NO: 820, SEQ ID NO: 1147, SEQ ID NO: 1148, SEQ ID NO: 1364, SEQ ID NO: 1366, SEQ ID NO: 1370, SEQ ID NO: 4443, SEQ ID NO: 4446, SEQ ID NO: 4452, SEQ ID NO: 4463, or SEQ ID NO: 4464. In some embodiments, the sense strand comprises, or consists of, a sequence selected from SEQ ID NO: 240, SEQ ID NO: 820, SEQ ID NO: 1148, SEQ ID NO: 1364, SEQ ID NO: 1366, SEQ ID NO: 4446 or SEQ ID NO: 4463.

In certain embodiments of the invention, the RNAi constructs comprise (i) a sense strand comprising a sequence selected from SEQ ID NOs: 5-1507, 3014-3664, or 4319-4512, nucleotides 1-19 of any one of SEQ ID NOs: 5-1507, 3014-3664, or 4319-4512, or nucleotides 2-19 of any one of SEQ ID NOs: 5-1507, 3014-3664, or 4319-4512, and (ii) an antisense strand comprising a sequence selected from SEQ ID NOs: 1508-3010, 3665-4315, or 4513-4687, nucleotides 1-19 of any one of SEQ ID NOs: 1508-3010, 3665-4315, or 4513-4687, or nucleotides 2-19 of any one of SEQ ID NOs: 1508-3010, 3665-4315, or 4513-4687. In some embodiments, the RNAi constructs comprise (i) a sense strand comprising, or consisting of, a sequence selected from SEQ ID NO: 103, SEQ ID NO: 181, SEQ ID NO: 205, SEQ ID NO: 211, SEQ ID NO: 240, SEQ ID NO: 251, SEQ ID NO: 378, SEQ ID NO: 394, SEQ ID NO: 818, SEQ ID NO: 820, SEQ ID NO: 988, SEQ ID NO: 1005, SEQ ID NO: 1050, SEQ ID NO: 1147, SEQ ID NO: 1148, SEQ ID NO: 443, SEQ ID NO: 499, SEQ ID NO: 1362, SEQ ID NO 1364, SEQ ID NO: 1366, SEQ ID NO: 1370, SEQ ID NO: 1466, SEQ ID NO: 3050, SEQ ID NO: 3051, SEQ ID NO: 3065, SEQ ID NO: 3067, SEQ ID NO: 3071, SEQ ID NO: 4443, SEQ ID NO: 4444, SEQ ID NO: 4446, SEQ ID NO: 4452, SEQ ID NO: 4455, SEQ ID NO: 4459, SEQ ID NO: 4463, or SEQ ID NO: 4464 and (ii) an antisense strand comprising, or consisting of, a sequence selected from SEQ ID NO: 1606, SEQ ID NO: 1684, SEQ ID NO: 1708, SEQ ID NO: 1714, SEQ ID NO: 1743, SEQ ID NO: 1754, SEQ ID NO: 1881, SEQ ID NO: 1897, SEQ ID NO: 2321, SEQ ID NO: 2323, SEQ ID NO: 2491, SEQ ID NO: 2508, SEQ ID NO: 2553, SEQ ID NO: 2650, SEQ ID NO: 2651, SEQ ID NO: 1946, SEQ ID NO: 2002, SEQ ID NO: 2865, SEQ ID NO: 2867, SEQ ID NO: 2869, SEQ ID NO: 2873, SEQ ID NO: 2969, SEQ ID NO: 3701, SEQ ID NO: 3702, SEQ ID NO: 3716, SEQ ID NO: 3718, SEQ ID NO: 3722, SEQ ID NO: 4618, SEQ ID NO: 4619, SEQ ID NO: 4621, SEQ ID NO: 4627, SEQ ID NO: 4630, SEQ ID NO: 4634, SEQ ID NO: 4638, or SEQ ID NO: 4639. In other embodiments, the RNAi constructs comprise (i) a sense strand comprising, or consisting of, a sequence selected from SEQ ID NO: 181, SEQ ID NO: 205, SEQ ID NO: 211, SEQ ID NO: 240, SEQ ID NO: 820, SEQ ID NO: 1147, SEQ ID NO: 1148, SEQ ID NO: 1364, SEQ ID NO: 1366, SEQ ID NO: 1370, SEQ ID NO: 4443, SEQ ID NO: 4446, SEQ ID NO: 4452, SEQ ID NO: 4463, or SEQ ID NO: 4464, and (ii) an antisense strand comprising, or consisting of, a sequence selected from SEQ ID NO: 1684, SEQ ID NO: 1708, SEQ ID NO: 1714, SEQ ID NO: 1743, SEQ ID NO: 2323, SEQ ID NO: 2650, SEQ ID NO: 2651, SEQ ID NO: 2867, SEQ ID NO: 2869, SEQ ID NO: 2873, SEQ ID NO: 4618, SEQ ID NO: 4621, SEQ ID NO: 4627, SEQ ID NO: 4638, or SEQ ID NO: 4639. In still other embodiments, the RNAi constructs comprise (i) a sense strand comprising, or consisting of, a sequence selected from SEQ ID NO: 240, SEQ ID NO: 820, SEQ ID NO: 1148, SEQ ID NO: 1364, SEQ ID NO: 1366, SEQ ID NO: 4446 or SEQ ID NO: 4463, and (ii) an antisense strand comprising, or consisting of, a sequence selected from SEQ ID NO: 1743, SEQ ID NO: 2323, SEQ ID NO: 2651, SEQ ID NO: 2867, SEQ ID NO: 2869, SEQ ID NO: 4621, or SEQ ID NO: 4638.

In certain embodiments, the RNAi constructs comprise: (a) a sense strand comprising the sequence of SEQ ID NO:

181 and an antisense strand comprising the sequence of SEQ ID NO: 1684; (b) a sense strand comprising the sequence of SEQ ID NO: 205 and an antisense strand comprising the sequence of SEQ ID NO: 1708; (c) a sense strand comprising the sequence of SEQ ID NO: 211 and an antisense strand comprising the sequence of SEQ ID NO: 1714; (d) a sense strand comprising the sequence of SEQ ID NO: 240 and an antisense strand comprising the sequence of SEQ ID NO: 1743; (e) a sense strand comprising the sequence of SEQ ID NO: 820 and an antisense strand comprising the sequence of SEQ ID NO: 2323; (f) a sense strand comprising the sequence of SEQ ID NO: 1147 and an antisense strand comprising the sequence of SEQ ID NO: 2650; (g) a sense strand comprising the sequence of SEQ ID NO: 1148 and an antisense strand comprising the sequence of SEQ ID NO: 2651; (h) a sense strand comprising the sequence of SEQ ID NO: 1364 and an antisense strand comprising the sequence of SEQ ID NO: 2867; (i) a sense strand comprising the sequence of SEQ ID NO: 1366 and an antisense strand comprising the sequence of SEQ ID NO: 2869; or (j) a sense strand comprising the sequence of SEQ ID NO: 1370 and an antisense strand comprising the sequence of SEQ ID NO: 2873.

The RNAi construct of the invention can be any of the duplex compounds listed in Tables 1 to 10 (including the nucleotide sequences and/or chemical modifications of the compounds). In some embodiments, the RNAi construct is any of the duplex compounds listed in Table 1. In other embodiments, the RNAi construct is any of the duplex compounds listed in Table 6 (including the nucleotide sequences and/or chemical modifications of the compounds). In still other embodiments, the RNAi construct is any of the duplex compounds listed in Table 8 (including the nucleotide sequences and/or chemical modifications of the compounds). In certain embodiments, the RNAi construct is D-1098, D-1176, D-1200, D-1206, D-1235, D-1246, D-1373, D-1389, D-1813, D-1815, D-1983, D-2000, D-2045, D-2142, D-2143, D-1438, D-1494, D-2357, D-2359, D-2361, D-2365, D-2461, D-3036, D-3037, D-3051, D-3053, D-3057, D-3779, D-3780, D-3782, D-3788, D-3791, D-3795, D-3799, or D-3800. In some embodiments, the RNAi construct is D-1200, D-1206, D-1235, D-1815, D-2143, D-2359, D-2361, D-2365, D-2142, D-1176, D-3779, D-3782, D-3788, D-3799, or D-3800. In one particular embodiment, the RNAi construct is D-1235. In another particular embodiment, the RNAi construct is D-2143. In another embodiment, the RNAi construct is D-2361. In another embodiment, the RNAi construct is D-1815. In another embodiment, the RNAi construct is D-2359. In still another embodiment, the RNAi construct is D-3782. In yet another embodiment, the RNAi construct is D-3799.

In certain embodiments, the antisense strands of the RNAi constructs of the invention may target certain regions of the ASGR1 mRNA sequence. For instance, in some embodiments, the antisense strand of an RNAi construct of the invention comprises a sequence that is substantially complementary or fully complementary to nucleotides 692 to 721 of the human ASGR1 mRNA transcript set forth in SEQ ID NO: 1, nucleotides 692 to 716 of the human ASGR1 mRNA transcript set forth in SEQ ID NO: 1, or nucleotides 692 to 710 of the human ASGR1 mRNA transcript set forth in SEQ ID NO: 1. In such embodiments, the RNAi construct may comprise a sense strand that is substantially complementary or fully complementary to the antisense strand targeting this region. Thus, in these embodiments, the sense strand may comprise a sequence identical to nucleotides 692 to 721, nucleotides 692 to 716, or nucleotides 692 to 710 of SEQ ID NO: 1.

In other embodiments, the antisense strand of an RNAi construct of the invention comprises a sequence that is substantially complementary or fully complementary to nucleotides 396 to 425 of the human ASGR1 mRNA transcript set forth in SEQ ID NO: 1, nucleotides 396 to 420 of the human ASGR1 mRNA transcript set forth in SEQ ID NO: 1, or nucleotides 396 to 414 of the human ASGR1 mRNA transcript set forth in SEQ ID NO: 1. In such embodiments, the RNAi construct may comprise a sense strand that is substantially complementary or fully complementary to the antisense strand targeting this region. Thus, in these embodiments, the sense strand may comprise a sequence identical to nucleotides 396 to 425, nucleotides 396 to 420, or nucleotides 396 to 414 of SEQ ID NO: 1.

In still other embodiments, the antisense strand of an RNAi construct of the invention comprises a sequence that is substantially complementary or fully complementary to nucleotides 886 to 915 of the human ASGR1 mRNA transcript set forth in SEQ ID NO: 1, nucleotides 886 to 910 of the human ASGR1 mRNA transcript set forth in SEQ ID NO: 1, or nucleotides 886 to 904 of the human ASGR1 mRNA transcript set forth in SEQ ID NO: 1. In such embodiments, the RNAi construct may comprise a sense strand that is substantially complementary or fully complementary to the antisense strand targeting this region. Thus, in these embodiments, the sense strand may comprise a sequence identical to nucleotides 886 to 915, nucleotides 886 to 910, or nucleotides 886 to 904 of SEQ ID NO: 1.

The RNAi constructs of the invention may comprise one or more modified nucleotides. A "modified nucleotide" refers to a nucleotide that has one or more chemical modifications to the nucleoside, nucleobase, pentose ring, or phosphate group. As used herein, modified nucleotides do not encompass ribonucleotides containing adenosine monophosphate, guanosine monophosphate, uridine monophosphate, and cytidine monophosphate, and deoxyribonucleotides containing deoxyadenosine monophosphate, deoxyguanosine monophosphate, deoxythymidine monophosphate, and deoxycytidine monophosphate. However, the RNAi constructs may comprise combinations of modified nucleotides, ribonucleotides, and deoxyribonucleotides. Incorporation of modified nucleotides into one or both strands of double-stranded RNA molecules can improve the in vivo stability of the RNA molecules, e.g., by reducing the molecules' susceptibility to nucleases and other degradation processes. The potency of RNAi constructs for reducing expression of the target gene can also be enhanced by incorporation of modified nucleotides.

In certain embodiments, the modified nucleotides have a modification of the ribose sugar. These sugar modifications can include modifications at the 2' and/or 5' position of the pentose ring as well as bicyclic sugar modifications. A 2'-modified nucleotide refers to a nucleotide having a pentose ring with a substituent at the 2' position other than H or OH. Such 2'-modifications include, but are not limited to, 2'-O-alkyl (e.g. O—$C_1$-$C_{10}$ or O—$C_1$-$C_{10}$ substituted alkyl), 2'-O-allyl (O—$CH_2CH=CH_2$), 2'-C-allyl, 2'-fluoro, 2'-O-methyl ($OCH_3$), 2'-O-methoxyethyl (O—$(CH_2)_2OCH_3$), 2'-$OCF_3$, 2'-O$(CH_2)_2SCH_3$, 2'-O-aminoalkyl, 2'-amino (e.g. $NH_2$), 2'-O-ethylamine, and 2'-azido. Modifications at the 5' position of the pentose ring include, but are not limited to, 5'-methyl (R or S); 5'-vinyl, and 5'-methoxy.

A "bicyclic sugar modification" refers to a modification of the pentose ring where a bridge connects two atoms of the ring to form a second ring resulting in a bicyclic sugar structure. In some embodiments the bicyclic sugar modification comprises a bridge between the 4' and 2' carbons of the pentose ring. Nucleotides comprising a sugar moiety with a bicyclic sugar modification are referred to herein as bicyclic nucleic acids or BNAs. Exemplary bicyclic sugar modifications include, but are not limited to, α-L-Methyleneoxy (4'-CH$_2$—O-2') bicyclic nucleic acid (BNA); β-D-Methyleneoxy (4'-CH$_2$—O-2') BNA (also referred to as a locked nucleic acid or LNA); Ethyleneoxy (4'-(CH$_2$)$_2$—O-2') BNA; Aminooxy (4'-CH$_2$—O—N(R)-2') BNA; Oxyamino (4'-CH$_2$—N(R)—O-2') BNA; Methyl(methyleneoxy) (4'-CH(CH$_3$)—O-2') BNA (also referred to as constrained ethyl or cEt); methylene-thio (4'-CH$_2$—S-2') BNA; methylene-amino (4'-CH$_2$—N(R)-2') BNA; methyl carbocyclic (4'-CH$_2$—CH(CH$_3$)-2') BNA; propylene carbocyclic (4'-(CH$_2$)$_3$-2') BNA; and Methoxy(ethyleneoxy) (4'-CH(CH$_2$OMe)-O-2') BNA (also referred to as constrained MOE or cMOE). These and other sugar-modified nucleotides that can be incorporated into the RNAi constructs of the invention are described in U.S. Pat. No. 9,181,551, U.S. Patent Publication No. 2016/0122761, and Deleavey and Damha, Chemistry and Biology, Vol. 19: 937-954, 2012, all of which are hereby incorporated by reference in their entireties.

In some embodiments, the RNAi constructs comprise one or more 2'-fluoro modified nucleotides, 2'-O-methyl modified nucleotides, 2'-O-methoxyethyl modified nucleotides, 2'-O-allyl modified nucleotides, bicyclic nucleic acids (BNAs), or combinations thereof. In certain embodiments, the RNAi constructs comprise one or more 2'-fluoro modified nucleotides, 2'-O-methyl modified nucleotides, 2'-O-methoxyethyl modified nucleotides, or combinations thereof. In one particular embodiment, the RNAi constructs comprise one or more 2'-fluoro modified nucleotides, 2'-O-methyl modified nucleotides or combinations thereof.

Both the sense and antisense strands of the RNAi constructs can comprise one or multiple modified nucleotides. For instance, in some embodiments, the sense strand comprises 1, 2, 3, 4, 5, 6, 7, 8, 9, 10 or more modified nucleotides. In certain embodiments, all nucleotides in the sense strand are modified nucleotides. In some embodiments, the antisense strand comprises 1, 2, 3, 4, 5, 6, 7, 8, 9, 10 or more modified nucleotides. In other embodiments, all nucleotides in the antisense strand are modified nucleotides. In certain other embodiments, all nucleotides in the sense strand and all nucleotides in the antisense strand are modified nucleotides. In these and other embodiments, the modified nucleotides can be 2'-fluoro modified nucleotides, 2'-O-methyl modified nucleotides, or combinations thereof.

In some embodiments, all pyrimidine nucleotides preceding an adenosine nucleotide in the sense strand, antisense strand, or both strands are modified nucleotides. For example, where the sequence 5'-CA-3' or 5'-UA-3' appears in either strand, the cytidine and uridine nucleotides are modified nucleotides, preferably 2'-O-methyl modified nucleotides. In certain embodiments, all pyrimidine nucleotides in the sense strand are modified nucleotides (e.g. 2'-O-methyl modified nucleotides), and the 5' nucleotide in all occurrences of the sequence 5'-CA-3' or 5'-UA-3' in the antisense strand are modified nucleotides (e.g. 2'-O-methyl modified nucleotides). In other embodiments, all nucleotides in the duplex region are modified nucleotides. In such embodiments, the modified nucleotides are preferably 2'-O-methyl modified nucleotides, 2'-fluoro modified nucleotides or combinations thereof.

In embodiments in which the RNAi construct comprises a nucleotide overhang, the nucleotides in the overhang can be ribonucleotides, deoxyribonucleotides, or modified nucleotides. In one embodiment, the nucleotides in the overhang are deoxyribonucleotides, e.g. deoxythymidine. In another embodiment, the nucleotides in the overhang are modified nucleotides. For instance, in some embodiments, the nucleotides in the overhang are 2'-O-methyl modified nucleotides, 2'-fluoro modified nucleotides, 2'-methoxyethyl modified nucleotides, or combinations thereof.

The RNAi constructs of the invention may also comprise one or more modified internucleotide linkages. As used herein, the term "modified internucleotide linkage" refers to an internucleotide linkage other than the natural 3' to 5' phosphodiester linkage. In some embodiments, the modified internucleotide linkage is a phosphorous-containing internucleotide linkage, such as a phosphotriester, aminoalkylphosphotriester, an alkylphosphonate (e.g. methylphosphonate, 3'-alkylene phosphonate), a phosphinate, a phosphoramidate (e.g. 3'-amino phosphoramidate and aminoalkylphosphoramidate), a phosphorothioate (P=S), a chiral phosphorothioate, a phosphorodithioate, a thionophosphoramidate, a thionoalkylphosphonate, a thionoalkylphosphotriester, and a boranophosphate. In one embodiment, a modified internucleotide linkage is a 2' to 5' phosphodiester linkage. In other embodiments, the modified internucleotide linkage is a non-phosphorous-containing internucleotide linkage and thus can be referred to as a modified internucleoside linkage. Such non-phosphorous-containing linkages include, but are not limited to, morpholino linkages (formed in part from the sugar portion of a nucleoside); siloxane linkages (—O—Si(H)$_2$—O—); sulfide, sulfoxide and sulfone linkages; formacetyl and thioformacetyl linkages; alkene containing backbones; sulfamate backbones; methylenemethylimino (—CH$_2$—N(CH$_3$)—O—CH$_2$—) and methylenehydrazino linkages; sulfonate and sulfonamide linkages; amide linkages; and others having mixed N, O, S and CH$_2$ component parts. In one embodiment, the modified internucleoside linkage is a peptide-based linkage (e.g. aminoethylglycine) to create a peptide nucleic acid or PNA, such as those described in U.S. Pat. Nos. 5,539,082; 5,714,331; and 5,719,262. Other suitable modified internucleotide and internucleoside linkages that may be employed in the RNAi constructs of the invention are described in U.S. Pat. Nos. 6,693,187, 9,181,551, U.S. Patent Publication No. 2016/0122761, and Deleavey and Damha, Chemistry and Biology, Vol. 19: 937-954, 2012, all of which are hereby incorporated by reference in their entireties.

In certain embodiments, the RNAi constructs comprise one or more phosphorothioate internucleotide linkages. The phosphorothioate internucleotide linkages may be present in the sense strand, antisense strand, or both strands of the RNAi constructs. For instance, in some embodiments, the sense strand comprises 1, 2, 3, 4, 5, 6, 7, 8, or more phosphorothioate internucleotide linkages. In other embodiments, the antisense strand comprises 1, 2, 3, 4, 5, 6, 7, 8, or more phosphorothioate internucleotide linkages. In still other embodiments, both strands comprise 1, 2, 3, 4, 5, 6, 7, 8, or more phosphorothioate internucleotide linkages. The RNAi constructs can comprise one or more phosphorothioate internucleotide linkages at the 3'-end, the 5'-end, or both the 3'- and 5'-ends of the sense strand, the antisense strand, or both strands. For instance, in certain embodiments, the RNAi construct comprises about 1 to about 6 or more (e.g., about 1, 2, 3, 4, 5, 6 or more) consecutive phosphorothioate internucleotide linkages at the 3'-end of the sense strand, the antisense strand, or both strands. In other embodiments, the RNAi construct comprises about 1 to about 6 or more (e.g., about 1, 2, 3, 4, 5, 6 or more) consecutive phosphorothioate internucleotide linkages at the 5'-end of the sense strand, the antisense strand, or both strands. In one embodiment, the RNAi construct comprises a single phosphorothioate internucleotide linkage at the 3' end of the sense strand and a single phosphorothioate internucleotide linkage at the 3' end of the antisense strand. In another embodiment, the RNAi construct comprises two consecutive phosphorothioate internucleotide linkages at the 3' end of the antisense strand (i.e. a phosphorothioate internucleotide linkage at the first and second internucleotide linkages at the 3' end of the antisense strand). In another embodiment, the RNAi construct comprises two consecutive phosphorothioate internucleotide linkages at both the 3' and 5' ends of the antisense strand. In yet another embodiment, the RNAi construct comprises two consecutive phosphorothioate internucleotide linkages at both the 3' and 5' ends of the antisense strand and two consecutive phosphorothioate internucleotide linkages at the 5' end of the sense strand. In still another embodiment, the RNAi construct comprises two consecutive phosphorothioate internucleotide linkages at both the 3' and 5' ends of the antisense strand and two consecutive phosphorothioate internucleotide linkages at both the 3' and 5' ends of the sense strand (i.e. a phosphorothioate internucleotide linkage at the first and second internucleotide linkages at both the 5' and 3' ends of the antisense strand and a phosphorothioate internucleotide linkage at the first and second internucleotide linkages at both the 5' and 3' ends of the sense strand). In any of the embodiments in which one or both strands comprises one or more phosphorothioate internucleotide linkages, the remaining internucleotide linkages within the strands can be the natural 3' to 5' phosphodiester linkages. For instance, in some embodiments, each internucleotide linkage of the sense and antisense strands is selected from phosphodiester and phosphorothioate, wherein at least one internucleotide linkage is a phosphorothioate.

In embodiments in which the RNAi construct comprises a nucleotide overhang, two or more of the unpaired nucleotides in the overhang can be connected by a phosphorothioate internucleotide linkage. In certain embodiments, all the unpaired nucleotides in a nucleotide overhang at the 3' end of the antisense strand and/or the sense strand are connected by phosphorothioate internucleotide linkages. In other embodiments, all the unpaired nucleotides in a nucleotide overhang at the 5' end of the antisense strand and/or the sense strand are connected by phosphorothioate internucleotide linkages. In still other embodiments, all the unpaired nucleotides in any nucleotide overhang are connected by phosphorothioate internucleotide linkages.

In certain embodiments, the modified nucleotides incorporated into one or both of the strands of the RNAi constructs of the invention have a modification of the nucleobase (also referred to herein as "base"). A "modified nucleobase" or "modified base" refers to a base other than the naturally occurring purine bases adenine (A) and guanine (G) and pyrimidine bases thymine (T), cytosine (C), and uracil (U). Modified nucleobases can be synthetic or naturally occurring modifications and include, but are not limited to, universal bases, 5-methylcytosine (5-me-C), 5-hydroxymethyl cytosine, xanthine (X), hypoxanthine (I), 2-aminoadenine, 6-methyladenine, 6-methylguanine, and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine.

In some embodiments, the modified base is a universal base. A "universal base" refers to a base analog that indiscriminately forms base pairs with all of the natural bases in RNA and DNA without altering the double helical structure of the resulting duplex region. Universal bases are known to those of skill in the art and include, but are not limited to, inosine, C-phenyl, C-naphthyl and other aromatic derivatives, azole carboxamides, and nitroazole derivatives, such as 3-nitropyrrole, 4-nitroindole, 5-nitroindole, and 6-nitroindole.

Other suitable modified bases that can be incorporated into the RNAi constructs of the invention include those described in Herdewijn, Antisense Nucleic Acid Drug Dev., Vol. 10: 297-310, 2000 and Peacock et al., J. Org. Chem., Vol. 76: 7295-7300, 2011, both of which are hereby incorporated by reference in their entireties. The skilled person is well aware that guanine, cytosine, adenine, thymine, and uracil may be replaced by other nucleobases, such as the modified nucleobases described above, without substantially altering the base pairing properties of a polynucleotide comprising a nucleotide bearing such replacement nucleobase.

In some embodiments, the sense and antisense strands of the RNAi constructs may comprise one or more abasic nulceotides. An "abasic nucleotide" or "abasic nucleoside" is a nucleotide or nucleoside that lacks a nucleobase at the 1' position of the ribose sugar. In certain embodiments, the abasic nucleotides are incorporated into the terminal ends of the sense and/or antisense strands of the RNAi constructs. In one embodiment, the sense strand comprises an abasic nucleotide as the terminal nucleotide at its 3' end, its 5' end, or both its 3' and 5' ends. In another embodiment, the antisense strand comprises an abasic nucleotide as the terminal nucleotide at its 3' end, its 5' end, or both its 3' and 5' ends. In such embodiments in which the abasic nucleotide is a terminal nucleotide, it may be linked to the adjacent nucleotide through a 3'-3' internucleotide linkage (i.e. an inverted nucleotide) rather than the natural 3'-5' internucleotide linkage.

In some embodiments of the RNAi constructs of the invention, the 5' end of the sense strand, antisense strand, or both the antisense and sense strands comprises a phosphate moiety. As used herein, the term "phosphate moiety" refers to a terminal phosphate group that includes unmodified phosphates (—O—P=O)(OH)OH) as well as modified phosphates. Modified phosphates include phosphates in which one or more of the O and OH groups is replaced with H, O, S, N(R) or alkyl where R is H, an amino protecting group or unsubstituted or substituted alkyl. Exemplary phosphate moieties include, but are not limited to, 5'-monophosphate; 5'-diphosphate; 5'-triphosphate; 5'-guanosine cap (7-methylated or non-methylated); 5'-adenosine cap or any other modified or unmodified nucleotide cap structure; 5'-monothiophosphate (phosphorothioate); 5'-monodithiophosphate (phosphorodithioate); 5'-alpha-thiotriphosphate; 5'-gamma-thiotriphosphate, 5'-phosphoramidates; 5'-vinylphosphates; 5'-alkylphosphonates (e.g., alkyl=methyl, ethyl, isopropyl, propyl, etc.); and 5'-alkyletherphosphonates (e.g., alkylether=methoxymethyl, ethoxymethyl, etc.).

The modified nucleotides that can be incorporated into the RNAi constructs of the invention may have more than one chemical modification described herein. For instance, the modified nucleotide may have a modification to the ribose sugar as well as a modification to the nucleobase. By way of example, a modified nucleotide may comprise a 2' sugar modification (e.g. 2'-fluoro or 2'-methyl) and comprise a modified base (e.g. 5-methyl cytosine or pseudouracil). In other embodiments, the modified nucleotide may comprise a sugar modification in combination with a modification to the 5' phosphate that would create a modified internucleotide or internucleoside linkage when the modified nucleotide was incorporated into a polynucleotide. For instance, in some embodiments, the modified nucleotide may comprise a sugar modification, such as a 2'-fluoro modification, a 2'-O-methyl modification, or a bicyclic sugar modification, as well as a 5' phosphorothioate group. Accordingly, in some embodiments, one or both strands of the RNAi constructs of the invention comprise a combination of 2' modified nucleotides or BNAs and phosphorothioate internucleotide linkages. In certain embodiments, both the sense and antisense strands of the RNAi constructs of the invention comprise a combination of 2'-fluoro modified nucleotides, 2'-O-methyl modified nucleotides, and phosphorothioate internucleotide linkages. Exemplary RNAi constructs comprising modified nucleotides and internucleotide linkages are shown in Tables 6 and 8.

Preferably, the RNAi constructs of the invention reduce or inhibit the expression of ASGR1 in cells, particularly liver cells. Accordingly, in one embodiment, the present invention provides a method of reducing ASGR1 expression in a cell by contacting the cell with any RNAi construct described herein. The cell may be in vitro or in vivo. ASGR1 expression can be assessed by measuring the amount or level of ASGR1 mRNA, ASGR1 protein, or another biomarker linked to ASGR1 expression, such as serum levels of alkaline phosphatase. The reduction of ASGR1 expression in cells or animals treated with an RNAi construct of the invention can be determined relative to the ASGR1 expression in cells or animals not treated with the RNAi construct or treated with a control RNAi construct. For instance, in some embodiments, reduction of ASGR1 expression is assessed by (a) measuring the amount or level of ASGR1 mRNA in liver cells treated with a RNAi construct of the invention, (b) measuring the amount or level of ASGR1 mRNA in liver cells treated with a control RNAi construct (e.g. RNAi agent directed to a RNA molecule not expressed in liver cells or a RNAi construct having a nonsense or scrambled sequence) or no construct, and (c) comparing the measured ASGR1 mRNA levels from treated cells in (a) to the measured ASGR1 mRNA levels from control cells in (b). The ASGR1 mRNA levels in the treated cells and controls cells can be normalized to RNA levels for a control gene (e.g. 18S ribosomal RNA or housekeeping gene) prior to comparison. ASGR1 mRNA levels can be measured by a variety of methods, including Northern blot analysis, nuclease protection assays, fluorescence in situ hybridization (FISH), reverse-transcriptase (RT)-PCR, real-time RT-PCR, quantitative PCR, droplet digital PCR, and the like.

In other embodiments, reduction of ASGR1 expression is assessed by (a) measuring the amount or level of ASGR1 protein in liver cells treated with a RNAi construct of the invention, (b) measuring the amount or level of ASGR1 protein in liver cells treated with a control RNAi construct (e.g. RNAi agent directed to a RNA molecule not expressed in liver cells or a RNAi construct having a nonsense or scrambled sequence) or no construct, and (c) comparing the measured ASGR1 protein levels from treated cells in (a) to the measured ASGR1 protein levels from control cells in (b). Methods of measuring ASGR1 protein levels are known to those of skill in the art, and include Western Blots, immunoassays (e.g. ELISA), and flow cytometry. An exemplary immunoassay-based method for assessing ASGR1 protein expression is described in Examples 2 and 7. Example 3 describes an exemplary method for measuring ASGR1 mRNA using RNA FISH, and Example 8 describes an exemplary method for assessing ASGR1 mRNA using droplet digital PCR. Any method capable of measuring ASGR1 mRNA or protein can be used to assess the efficacy of the RNAi constructs of the invention.

In some embodiments, the methods to assess ASGR1 expression levels are performed in vitro in cells that natively express ASGR1 (e.g. liver cells) or cells that have been engineered to express ASGR1. In certain embodiments, the methods are performed in vitro in liver cells. Suitable liver cells include, but are not limited to, primary hepatocytes (e.g. human, non-human primate, or rodent hepatocytes), HepAD38 cells, HuH-6 cells, HuH-7 cells, HuH-5-2 cells, BNLCL2 cells, Hep3B cells, or HepG2 cells. In one embodiment, the liver cells are Hep3B cells. In another embodiment, the liver cells are human primary hepatopyctes.

In other embodiments, the methods to assess ASGR1 expression levels are performed in vivo. The RNAi constructs and any control RNAi constructs can be administered to an animal (e.g. rodent or non-human primate) and ASGR1 mRNA or protein levels assessed in liver tissue harvested from the animal following treatment. Alternatively or additionally, a biomarker or functional phenotype associated with ASGR1 expression can be assessed in the treated animals. For instance, elevated serum alkaline phosphatase levels correlate with reduced serum levels of non-HDL cholesterol in individuals with loss of function mutations in the ASGR1 gene (Nioi et al., New England Journal of Medicine, Vol. 374(22):2131-2141, 2016, which is hereby incorporated by reference in its entirety). Thus, serum levels of alkaline phosphatase or non-HDL cholesterol can be measured in animals treated with RNAi constructs of the invention to assess the functional efficacy of reducing ASGR1 expression. Exemplary methods for these analyses are described in Examples 6, 9, and 10.

In certain embodiments, expression of ASGR1 is reduced in liver cells by at least 10%, at least 15%, at least 20%, at least 25%, at least 30%, at least 35%, at least 40%, at least 45%, or at least 50% by an RNAi construct of the invention. In some embodiments, expression of ASGR1 is reduced in liver cells by at least 60%, at least 65%, at least 70%, at least 75%, at least 80%, or at least 85% by an RNAi construct of the invention. In other embodiments, the expression of ASGR1 is reduced in liver cells by about 90% or more, e.g., 91%, 92%, 93%, 94%, 95%, 96%, 97%, 98%, 99%, or more by an RNAi construct of the invention. The percent reduction of ASGR1 expression can be measured by any of the methods described herein as well as others known in the art. For instance, in certain embodiments, the RNAi constructs of the invention inhibit at least 45% of ASGR1 expression at 5 nM in Hep3B cells in vitro. In related embodiments, the RNAi constructs of the invention inhibit at least 50%, at least 55%, at least 60%, at least 65%, at least 70%, or at least 75% of ASGR1 expression at 5 nM in Hep3B cells in vitro. In other embodiments, the RNAi constructs of the invention inhibit at least 80%, at least 85%, at least 90%, at least 92%, at least 94%, at least 96%, or at least 98% of ASGR1 expression at 5 nM in Hep3B cells in vitro.

In some embodiments, an IC50 value is calculated to assess the potency of an RNAi construct of the invention for inhibiting ASGR1 expression in liver cells. An "IC50 value"

is the dose/concentration required to achieve 50% inhibition of a biological or biochemical function. The IC50 value of any particular substance or antagonist can be determined by constructing a dose-response curve and examining the effect of different concentrations of the substance or antagonist on expression levels or functional activity in any assay. IC50 values can be calculated for a given antagonist or substance by determining the concentration needed to inhibit half of the maximum biological response or native expression levels. Thus, the IC50 value for any RNAi construct can be calculated by determining the concentration of the RNAi construct needed to inhibit half of the native ASGR1 expression level in liver cells (e.g. ASGR1 expression level in control liver cells) in any assay, such as the immunoassay, RNA FISH assay, qPCR or droplet digital PCR assays described in the Examples. The RNAi constructs of the invention may inhibit ASGR1 expression in liver cells (e.g. Hep3B cells) with an IC50 of less than about 10 nM, less than about 5 nM, or less than about 1 nM. For example, the RNAi constructs inhibit ASGR1 expression in liver cells with an IC50 of about 0.5 nM to about 10 nM, about 0.8 nM to about 8 nM, about 1 nM to about 5 nM, about 0.8 nM to about 3 nM, about 0.001 nM to about 1 nM, about 0.001 nM to about 0.50 nM, about 0.001 nM to about 0.1 nM, about 0.001 nM to about 0.01 nM, about 0.01 nM to about 0.50 nM, about 0.02 nM to about 0.80 nM, about 0.01 nM to about 1.0 nM, about 0.1 nM to about 0.9 nM, or about 0.05 nM to about 0.5 nM. In certain embodiments, the RNAi construct inhibits ASGR1 expression in liver cells (e.g. Hep3B cells) with an IC50 of about 0.5 nM to about 5 nM. In other embodiments, the RNAi construct inhibits ASGR1 expression in liver cells (e.g. Hep3B cells) with an IC50 of about 0.01 nM to about 0.9 nM.

The RNAi constructs of the invention can readily be made using techniques known in the art, for example, using conventional nucleic acid solid phase synthesis. The polynucleotides of the RNAi constructs can be assembled on a suitable nucleic acid synthesizer utilizing standard nucleotide or nucleoside precursors (e.g. phosphoramidites). Automated nucleic acid synthesizers are sold commercially by several vendors, including DNA/RNA synthesizers from Applied Biosystems (Foster City, CA), MerMade synthesizers from BioAutomation (Irving, TX), and OligoPilot synthesizers from GE Healthcare Life Sciences (Pittsburgh, Pa.).

The 2' silyl protecting group can be used in conjunction with acid labile dimethoxytrityl (DMT) at the 5' position of ribonucleosides to synthesize oligonucleotides via phosphoramidite chemistry. Final deprotection conditions are known not to significantly degrade RNA products. All syntheses can be conducted in any automated or manual synthesizer on large, medium, or small scale. The syntheses may also be carried out in multiple well plates, columns, or glass slides.

The 2'-O-silyl group can be removed via exposure to fluoride ions, which can include any source of fluoride ion, e.g., those salts containing fluoride ion paired with inorganic counterions e.g., cesium fluoride and potassium fluoride or those salts containing fluoride ion paired with an organic counterion, e.g., a tetraalkylammonium fluoride. A crown ether catalyst can be utilized in combination with the inorganic fluoride in the deprotection reaction. Preferred fluoride ion source are tetrabutylammonium fluoride or aminohydrofluorides (e.g., combining aqueous HF with triethylamine in a dipolar aprotic solvent, e.g., dimethylformamide).

The choice of protecting groups for use on the phosphite triesters and phosphotriesters can alter the stability of the triesters towards fluoride. Methyl protection of the phosphotriester or phosphitetriester can stabilize the linkage against fluoride ions and improve process yields.

Since ribonucleosides have a reactive 2' hydroxyl substituent, it can be desirable to protect the reactive 2' position in RNA with a protecting group that is orthogonal to a 5'-O-dimethoxytrityl protecting group, e.g., one stable to treatment with acid. Silyl protecting groups meet this criterion and can be readily removed in a final fluoride deprotection step that can result in minimal RNA degradation.

Tetrazole catalysts can be used in the standard phosphoramidite coupling reaction. Preferred catalysts include, e.g., tetrazole, S-ethyl-tetrazole, benzylthiotetrazole, p-nitrophenyltetrazole.

As can be appreciated by the skilled artisan, further methods of synthesizing the RNAi constructs described herein will be evident to those of ordinary skill in the art. Additionally, the various synthetic steps may be performed in an alternate sequence or order to give the desired compounds. Other synthetic chemistry transformations, protecting groups (e.g., for hydroxyl, amino, etc. present on the bases) and protecting group methodologies (protection and deprotection) useful in synthesizing the RNAi constructs described herein are known in the art and include, for example, those such as described in R. Larock, Comprehensive Organic Transformations, VCH Publishers (1989); T. W. Greene and P. G. M. Wuts, Protective Groups in Organic Synthesis, 2d. Ed., John Wiley and Sons (1991); L. Fieser and M. Fieser, Fieser and Fieser's Reagents for Organic Synthesis, John Wiley and Sons (1994); and L. Paquette, ed., Encyclopedia of Reagents for Organic Synthesis, John Wiley and Sons (1995), and subsequent editions thereof. Custom synthesis of RNAi agents is also available from several commercial vendors, including Dharmacon, Inc. (Lafayette, Colo.), AxoLabs GmbH (Kulmbach, Germany), and Ambion, Inc. (Foster City, Calif.).

The RNAi constructs of the invention may comprise a ligand. As used herein, a "ligand" refers to any compound or molecule that is capable of interacting with another compound or molecule, directly or indirectly. The interaction of a ligand with another compound or molecule may elicit a biological response (e.g. initiate a signal transduction cascade, induce receptor-mediated endocytosis) or may just be a physical association. The ligand can modify one or more properties of the double-stranded RNA molecule to which is attached, such as the pharmacodynamic, pharmacokinetic, binding, absorption, cellular distribution, cellular uptake, charge and/or clearance properties of the RNA molecule.

The ligand may comprise a serum protein (e.g., human serum albumin, low-density lipoprotein, globulin), a cholesterol moiety, a vitamin (biotin, vitamin E, vitamin B12), a folate moiety, a steroid, a bile acid (e.g. cholic acid), a fatty acid (e.g., palmitic acid, myristic acid), a carbohydrate (e.g., a dextran, pullulan, chitin, chitosan, inulin, cyclodextrin or hyaluronic acid), a glycoside, a phospholipid, or antibody or binding fragment thereof (e.g. antibody or binding fragment that targets the RNAi construct to a specific cell type, such as liver). Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g, adamantane acetic acid, 1-pyrene butyric acid, dihydrotestosterone, 1,3-Bis-O(hexadecyl)glycerol, geranyloxyhexyl group, hexadecylglycerol, borneol, menthol, 1,3-propanediol, heptadecyl group, O3-(oleoyl)litho-cholic acid, O3-(oleoyl)cholenic acid, dimethoxytrityl, or phenoxazine), peptides (e.g., antennapedia peptide, Tat peptide, RGD peptides), alkylating agents, polymers, such as polyethylene glycol (PEG)(e.g., PEG-40K), polyamino acids, and polyamines (e.g. spermine, spermidine).

In certain embodiments, the ligands have endosomolytic properties. The endosomolytic ligands promote the lysis of the endosome and/or transport of the RNAi construct of the invention, or its components, from the endosome to the cytoplasm of the cell. The endosomolytic ligand may be a polycationic peptide or peptidomimetic, which shows pH-dependent membrane activity and fusogenicity. In one embodiment, the endosomolytic ligand assumes its active conformation at endosomal pH. The "active" conformation is that conformation in which the endosomolytic ligand promotes lysis of the endosome and/or transport of the RNAi construct of the invention, or its components, from the endosome to the cytoplasm of the cell. Exemplary endosomolytic ligands include the GALA peptide (Subbarao et al., Biochemistry, Vol. 26: 2964-2972, 1987), the EALA peptide (Vogel et al., J. Am. Chem. Soc., Vol. 118: 1581-1586, 1996), and their derivatives (Turk et al., Biochem. Biophys. Acta, Vol. 1559: 56-68, 2002). In one embodiment, the endosomolytic component may contain a chemical group (e.g., an amino acid) which will undergo a change in charge or protonation in response to a change in pH. The endosomolytic component may be linear or branched.

In some embodiments, the ligand comprises a lipid or other hydrophobic molecule. In one embodiment, the ligand comprises a cholesterol moiety or other steroid. Cholesterol-conjugated oligonucleotides have been reported to be more active than their unconjugated counterparts (Manoharan, Antisense Nucleic Acid Drug Development, Vol. 12: 103-228, 2002). Ligands comprising cholesterol moieties and other lipids for conjugation to nucleic acid molecules have also been described in U.S. Pat. Nos. 7,851,615; 7,745,608; and 7,833,992, all of which are hereby incorporated by reference in their entireties. In another embodiment, the ligand comprises a folate moiety. Polynucleotides conjugated to folate moieties can be taken up by cells via a receptor-mediated endocytosis pathway. Such folate-polynucleotide conjugates are described in U.S. Pat. No. 8,188, 247, which is hereby incorporated by reference in its entirety.

Given that ASGR1 is expressed on the surface of liver cells (e.g. hepatocytes) as a component of the asialoglycoprotein receptor (ASGR), in certain embodiments, it is desirable to specifically deliver the RNAi construct to those liver cells. Accordingly, in certain embodiments, the ligand targets delivery of the RNAi constructs specifically to liver cells (e.g. hepatocytes) using various approaches as described in more detail below. In certain embodiments, the RNAi constructs are targeted to liver cells with a ligand that binds to the surface-expressed ASGR, ASGR1 and/or ASGR2. In these embodiments, it is envisioned that this targeting approach can result in a self-regulating system that reduces the amount of RNAi construct delivered to the liver cells as expression of ASGR1 is reduced due to the effect of the previously delivered RNAi construct.

In some embodiments, RNAi constructs can be specifically targeted to the liver by employing ligands that bind to or interact with proteins expressed on the surface of liver cells. For example, in certain embodiments, the ligands may comprise antigen binding proteins (e.g. antibodies or binding fragments thereof (e.g. Fab, scFv)) that specifically bind to a receptor expressed on hepatocytes, such as the asialoglycoprotein receptor and the LDL receptor. In one particular embodiment, the ligand comprises an antibody or binding fragment thereof that specifically binds to ASGR1 and/or ASGR2. In another embodiment, the ligand comprises a Fab fragment of an antibody that specifically binds to ASGR1 and/or ASGR2. A "Fab fragment" is comprised of one immunoglobulin light chain (i.e. light chain variable region (VL) and constant region (CL)) and the CH1 region and variable region (VH) of one immunoglobulin heavy chain. In another embodiment, the ligand comprises a single-chain variable antibody fragment (scFv fragment) of an antibody that specifically binds to ASGR1 and/or ASGR2. An "scFv fragment" comprises the VH and VL regions of an antibody, wherein these regions are present in a single polypeptide chain, and optionally comprising a peptide linker between the VH and VL regions that enables the Fv to form the desired structure for antigen binding. Exemplary antibodies and binding fragments thereof that specifically bind to ASGR1 that can be used as ligands for targeting the RNAi constructs of the invention to the liver are described in U.S. Patent Application No. 62/234,546 and WIPO Publication No. WO 2017/058944, both of which are hereby incorporated by reference in their entireties. Other antibodies or binding fragments thereof that specifically bind to ASGR1, LDL receptor, or other liver surface-expressed proteins suitable for use as ligands in the RNAi constructs of the invention are commercially available.

In some embodiments, the ligand comprises a cys monoclonal antibody (mAb) or antigen-binding fragment thereof. A "cys mAb" is a monoclonal antibody or antigen-binding fragment thereof in which at least one amino acid in the light chain or heavy chain has been substituted with a cysteine amino acid or at least one cysteine amino acid has been inserted into the primary sequence of the light chain or heavy chain. The free thiol group in the side chain of the cysteine amino acid provides a conjugation site to which the sense strand of the RNAi constructs of the invention can be covalently linked. The cysteine substitutions/additions can be at the amino-terminus or carboxy-terminus of the light chain or heavy chain of the antibody or antigen-binding fragment. Alternatively or additionally, the cysteine substitutions/additions can be located at an internal site within the light chain or heavy chain so long as the cysteine substitution/addition does not affect the binding affinity of the antibody or antigen-binding fragment to its target antigen (e.g. ASGR1). Exemplary amino acids within the heavy and light chains of antibodies that may be substituted with cysteine residues are described in WIPO Publication Nos. WO 2006/034488 and WO 2007/022070, both of which are hereby incorporated by reference in their entireties. In certain embodiments, the ligand comprises a cys mAb or antigen-binding fragment thereof that specifically binds to human ASGR1. An exemplary anti-ASGR1 cys mAb is described in Example 10. In one embodiment, the ligand comprises an anti-ASGR1 antibody having a heavy chain and a light chain, wherein the heavy chain comprises the sequence of SEQ ID NO: 4696 and the light chain comprises the sequence of SEQ ID NO: 4697. Anti-ASGR1 cys mAbs or antigen-binding fragments thereof may be covalently attached to the 5' end or 3' end of the sense strand of an RNAi construct of the invention, optionally through any of the linkers described herein. In some embodiments, the anti-ASGR1 antibody-RNA molecule conjugate comprises one copy of the interfering RNA molecule (e.g. siRNA or shRNA)(i.e. an RNAi-to-antibody ratio of 1). In other embodiments, the anti-ASGR1 antibody-RNA molecule conjugate comprises two copies of the interfering RNA molecule (e.g. siRNA or shRNA)(i.e. an RNAi-to-antibody ratio of 2).

In certain embodiments, the ligand comprises a carbohydrate. A "carbohydrate" refers to a compound made up of one or more monosaccharide units having at least 6 carbon atoms (which can be linear, branched or cyclic) with an oxygen, nitrogen or sulfur atom bonded to each carbon atom. Carbohydrates include, but are not limited to, the sugars (e.g., monosaccharides, disaccharides, trisaccharides, tetrasaccharides, and oligosaccharides containing from about 4, 5, 6, 7, 8, or 9 monosaccharide units), and polysaccharides, such as starches, glycogen, cellulose and polysaccharide gums. In some embodiments, the carbohydrate incorporated into the ligand is a monosaccharide selected from a pentose, hexose, or heptose and di- and tri-saccharides including such monosaccharide units. In other embodiments, the carbohydrate incorporated into the ligand is an amino sugar, such as galactosamine, glucosamine, N-acetyl-galactosamine, and N-acetylglucosamine.

In some embodiments, the ligand comprises a hexose or hexosamine. The hexose may be selected from glucose, galactose, mannose, fucose, or fructose. The hexosamine may be selected from fructosamine, galactosamine, glucosamine, or mannosamine. In certain embodiments, the ligand comprises glucose, galactose, galactosamine, or glucosamine. In one embodiment, the ligand comprises glucose, glucosamine, or N-acetylglucosamine. In another embodiment, the ligand comprises galactose, galactosamine, or N-acetyl-galactosamine. In particular embodiments, the ligand comprises N-acetyl-galactosamine. Ligands comprising glucose, galactose, and N-acetyl-galactosamine (GalNAc) are particularly effective in targeting compounds to liver cells because such ligands bind to the ASGR expressed on the surface of hepatocytes. See, e.g., D'Souza and Devarajan, J. Control Release, Vol. 203: 126-139, 2015. Examples of GalNAc- or galactose-containing ligands that can be incorporated into the RNAi constructs of the invention are described in U.S. Pat. Nos. 7,491,805; 8,106,022; and 8,877,917; U.S. Patent Publication No. 20030130186; and WIPO Publication No. WO 2013166155, all of which are hereby incorporated by reference in their entireties.

In certain embodiments, the ligand comprises a multivalent carbohydrate moiety. As used herein, a "multivalent carbohydrate moiety" refers to a moiety comprising two or more carbohydrate units capable of independently binding or interacting with other molecules. For example, a multivalent carbohydrate moiety comprises two or more binding domains comprised of carbohydrates that can bind to two or more different molecules or two or more different sites on the same molecule. The valency of the carbohydrate moiety denotes the number of individual binding domains within the carbohydrate moiety. For instance, the terms "monovalent," "bivalent," "trivalent," and "tetravalent" with reference to the carbohydrate moiety refer to carbohydrate moieties with one, two, three, and four binding domains, respectively. The multivalent carbohydrate moiety may comprise a multivalent lactose moiety, a multivalent galactose moiety, a multivalent glucose moiety, a multivalent N-acetyl-galactosamine moiety, a multivalent N-acetyl-glucosamine moiety, a multivalent mannose moiety, or a multivalent fucose moiety. In some embodiments, the ligand comprises a multivalent galactose moiety. In other embodiments, the ligand comprises a multivalent N-acetyl-galactosamine moiety. In these and other embodiments, the multivalent carbohydrate moiety is bivalent, trivalent, or tetravalent. In such embodiments, the multivalent carbohydrate moiety can be bi-antennary or tri-antennary. In one particular embodiment, the multivalent N-acetyl-galactosamine moiety is trivalent or tetravalent. In another particular embodiment, the multivalent galactose moiety is trivalent or tetravalent. Exemplary trivalent and tetravalent GalNAc-containing ligands for incorporation into the RNAi constructs of the invention are described in detail below.

The ligand can be attached or conjugated to the RNA molecule of the RNAi construct directly or indirectly. For instance, in some embodiments, the ligand is covalently attached directly to the sense or antisense strand of the RNAi construct. In other embodiments, the ligand is covalently attached via a linker to the sense or antisense strand of the RNAi construct. The ligand can be attached to nucleobases, sugar moieties, or internucleotide linkages of polynucleotides (e.g. sense strand or antisense strand) of the RNAi constructs of the invention. Conjugation or attachment to purine nucleobases or derivatives thereof can occur at any position including, endocyclic and exocyclic atoms. In certain embodiments, the 2-, 6-, 7-, or 8-positions of a purine nucleobase are attached to a ligand. Conjugation or attachment to pyrimidine nucleobases or derivatives thereof can also occur at any position. In some embodiments, the 2-, 5-, and 6-positions of a pyrimidine nucleobase can be attached to a ligand. Conjugation or attachment to sugar moieties of nucleotides can occur at any carbon atom. Example carbon atoms of a sugar moiety that can be attached to a ligand include the 2', 3', and 5' carbon atoms. The 1' position can also be attached to a ligand, such as in an abasic residue. Internucleotide linkages can also support ligand attachments. For phosphorus-containing linkages (e.g., phosphodiester, phosphorothioate, phosphorodithiotate, phosphoroamidate, and the like), the ligand can be attached directly to the phosphorus atom or to an O, N, or S atom bound to the phosphorus atom. For amine- or amide-containing internucleoside linkages (e.g., PNA), the ligand can be attached to the nitrogen atom of the amine or amide or to an adjacent carbon atom.

In certain embodiments, the ligand may be attached to the 3' or 5' end of either the sense or antisense strand. In certain embodiments, the ligand is covalently attached to the 5' end of the sense strand. In other embodiments, the ligand is covalently attached to the 3' end of the sense strand. For example, in some embodiments, the ligand is attached to the 3'-terminal nucleotide of the sense strand. In certain such embodiments, the ligand is attached at the 3'-position of the 3'-terminal nucleotide of the sense strand. In alternative embodiments, the ligand is attached near the 3' end of the sense strand, but before one or more terminal nucleotides (i.e. before 1, 2, 3, or 4 terminal nucleotides). In some embodiments, the ligand is attached at the 2'-position of the sugar of the 3'-terminal nucleotide of the sense strand.

In certain embodiments, the ligand is attached to the sense or antisense strand via a linker. A "linker" is an atom or group of atoms that covalently joins a ligand to a polynucleotide component of the RNAi construct. The linker may be from about 1 to about 30 atoms in length, from about 2 to about 28 atoms in length, from about 3 to about 26 atoms in length, from about 4 to about 24 atoms in length, from about 6 to about 20 atoms in length, from about 7 to about 20 atoms in length, from about 8 to about 20 atoms in length, from about 8 to about 18 atoms in length, from about 10 to about 18 atoms in length, and from about 12 to about 18 atoms in length. In some embodiments, the linker may comprise a bifunctional linking moiety, which generally comprises an alkyl moiety with two functional groups. One of the functional groups is selected to bind to the compound of interest (e.g. sense or antisense strand of the RNAi construct) and the other is selected to bind essentially any selected group, such as a ligand as described herein. In certain embodiments, the linker comprises a chain structure or an oligomer of repeating units, such as ethylene glycol or amino acid units. Examples of functional groups that are typically employed in a bifunctional linking moiety include, but are not limited to, electrophiles for reacting with nucleophilic groups and nucleophiles for reacting with electrophilic groups. In some embodiments, bifunctional linking moieties include amino, hydroxyl, carboxylic acid, thiol, unsaturations (e.g., double or triple bonds), and the like.

Linkers that may be used to attach a ligand to the sense or antisense strand in the RNAi constructs of the invention include, but are not limited to, pyrrolidine, 8-amino-3,6-dioxaoctanoic acid, succinimidyl 4-(N-maleimidomethyl) cyclohexane-1-carboxylate, 6-aminohexanoic acid, substituted $C_1$-$C_{10}$ alkyl, substituted or unsubstituted $C_2$-$C_{10}$ alkenyl or substituted or unsubstituted $C_2$-$C_{10}$ alkynyl. Preferred substituent groups for such linkers include, but are not limited to, hydroxyl, amino, alkoxy, carboxy, benzyl, phenyl, nitro, thiol, thioalkoxy, halogen, alkyl, aryl, alkenyl and alkynyl.

In certain embodiments, the linkers are cleavable. A cleavable linker is one which is sufficiently stable outside the cell, but which upon entry into a target cell is cleaved to release the two parts the linker is holding together. In some embodiments, the cleavable linker is cleaved at least 10 times, 20 times, 30 times, 40 times, 50 times, 60 times, 70 times, 80 times, 90 times, or more, or at least 100 times faster in the target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linkers are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linker by reduction; esterases; endosomes or agents that can create an acidic environment, e.g., those that result in a pH of five or lower; enzymes that can hydrolyze or degrade an acid cleavable linker by acting as a general acid, peptidases (which can be substrate specific), and phosphatases.

A cleavable linker may comprise a moiety that is susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable group that is cleaved at a preferred pH, thereby releasing the RNA molecule from the ligand inside the cell, or into the desired compartment of the cell.

A linker can include a cleavable group that is cleavable by a particular enzyme. The type of cleavable group incorporated into a linker can depend on the cell to be targeted. For example, liver-targeting ligands can be linked to RNA molecules through a linker that includes an ester group. Liver cells are rich in esterases, and therefore the linker will be cleaved more efficiently in liver cells than in cell types that are not esterase-rich. Other types of cells rich in esterases include cells of the lung, renal cortex, and testis.

Linkers that contain peptide bonds can be used when targeting cells rich in peptidases, such as liver cells and synoviocytes.

In general, the suitability of a candidate cleavable linker can be evaluated by testing the ability of a degradative agent (or condition) to cleave the candidate linker. It will also be desirable to also test the candidate cleavable linker for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It may be useful to make initial evaluations in cell-free or culture conditions and to confirm by further evaluations in whole animals. In some embodiments, useful candidate linkers are cleaved at least 2, 4, 10, 20, 50, 70, or 100 times faster in the cell (or under in vitro conditions selected to mimic intracellular conditions) as compared to blood or serum (or under in vitro conditions selected to mimic extracellular conditions).

In other embodiments, redox cleavable linkers are utilized. Redox cleavable linkers are cleaved upon reduction or oxidation. An example of reductively cleavable group is a disulfide linking group (—S—S—). To determine if a candidate cleavable linker is a suitable "reductively cleavable linker," or for example is suitable for use with a particular RNAi construct and particular ligand, one can use one or more methods described herein. For example, a candidate linker can be evaluated by incubation with dithiothreitol (DTT), or other reducing agent known in the art, which mimics the rate of cleavage that would be observed in a cell, e.g., a target cell. The candidate linkers can also be evaluated under conditions which are selected to mimic blood or serum conditions. In a specific embodiment, candidate linkers are cleaved by at most 10% in the blood. In other embodiments, useful candidate linkers are degraded at least 2, 4, 10, 20, 50, 70, or 100 times faster in the cell (or under in vitro conditions selected to mimic intracellular conditions) as compared to blood (or under in vitro conditions selected to mimic extracellular conditions).

In yet other embodiments, phosphate-based cleavable linkers are cleaved by agents that degrade or hydrolyze the phosphate group. An example of an agent that hydrolyzes phosphate groups in cells are enzymes, such as phosphatases in cells. Examples of phosphate-based cleavable groups are —O—P(O)(ORk)-O—, —O—P(S)(ORk)-O—, —O—P(S)(SRk)-O—, —S—P(O) (ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, and —O—P(S)(Rk)-S—, where Rk can be hydrogen or alkyl. Specific embodiments include —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O—, —S—P(S)(H)—O—, —S—P(O)(H)—S—, and —O—P(S)(H)—S—. Another specific embodiment is —O—P(O)(OH)—O—. These candidate linkers can be evaluated using methods analogous to those described above.

In other embodiments, the linkers may comprise acid cleavable groups, which are groups that are cleaved under acidic conditions. In some embodiments, acid cleavable groups are cleaved in an acidic environment with a pH of about 6.5 or lower (e.g., about 6.0, 5.5, 5.0, or lower), or by agents, such as enzymes that can act as a general acid. In a cell, specific low pH organelles, such as endosomes and lysosomes, can provide a cleaving environment for acid cleavable groups. Examples of acid cleavable linking groups include, but are not limited to, hydrazones, esters, and esters of amino acids. Acid cleavable groups can have the general formula —C=NN—, C(O)O, or —OC(O). A specific embodiment is when the carbon attached to the oxygen of the ester (the alkoxy group) is an aryl group, substituted alkyl group, or tertiary alkyl group such as dimethyl, pentyl or t-butyl. These candidates can be evaluated using methods analogous to those described above.

In other embodiments, the linkers may comprise ester-based cleavable groups, which are cleaved by enzymes, such as esterases and amidases in cells. Examples of ester-based cleavable groups include, but are not limited to, esters of alkylene, alkenylene and alkynylene groups. Ester cleavable groups have the general formula —C(O)O—, or —OC(O)—. These candidate linkers can be evaluated using methods analogous to those described above.

In further embodiments, the linkers may comprise peptide-based cleavable groups, which are cleaved by enzymes, such as peptidases and proteases in cells. Peptide-based cleavable groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynylene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHR$^A$C(O)NHCH$^B$C(O)—, where R$^A$ and R$^B$ are the side chains of the two adjacent amino acids. These candidates can be evaluated using methods analogous to those described above.

Exemplary linkers that can be employed for attaching ligands, particularly ligands comprising a GalNAc moiety, to the sense strand in the RNAi constructs of the invention, are shown in Formulas A-K below.

In one embodiment, the linker for attaching a ligand to the 3' end of the sense strand of an RNAi construct of the invention has the following structure of Formula A, wherein n is 1 or 2, R=ligand (e.g., moiety containing 3 to 4 GalNAc units) and R'=3' end of sense strand of a double stranded RNA molecule:

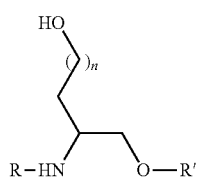

FORMULA A

In another embodiment, the linker for attaching a ligand to the 3' end of the sense strand of an RNAi construct of the invention has the following structure of Formula B, wherein n is 1, 2, or 3, R=ligand (e.g., moiety containing 3 to 4 GalNAc units) and R'=3' end of sense strand of a double stranded RNA molecule:

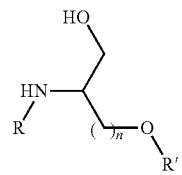

FORMULA B

In yet another embodiment, the linker for attaching a ligand to the 3' end of the sense strand of an RNAi construct of the invention has the following structure of Formula C, wherein n is 1 or 2, R=ligand (e.g., moiety containing 3 to 4 GalNAc units), R'=3' end of sense strand of a double stranded RNA molecule, and R"=H, alkyl, functionalized alkyl:

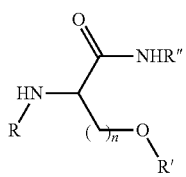

FORMULA C

In certain embodiments, the linker for attaching a ligand to the 3' end of the sense strand of an RNAi construct of the invention has the following structure of Formula D, wherein R=ligand (e.g., moiety containing 3 to 4 GalNAc units) and R'=3' end of sense strand of a double stranded RNA molecule:

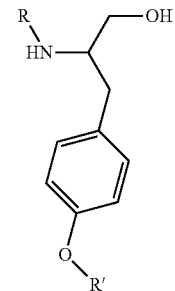

FORMULA D

In certain other embodiments, the linker for attaching a ligand to the 3' end of the sense strand of an RNAi construct of the invention has the following structure of Formula E, wherein R=ligand (e.g., moiety containing 3 to 4 GalNAc units) and R'=3' end of sense strand of a double stranded RNA molecule:

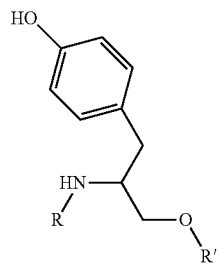

FORMULA E

In some embodiments, the linker for attaching a ligand to the 3' end of the sense strand of an RNAi construct of the invention has the following structure of Formula F, wherein R=ligand (e.g., moiety containing 3 to 4 GalNAc units) and R'=3' end of sense strand of a double stranded RNA molecule:

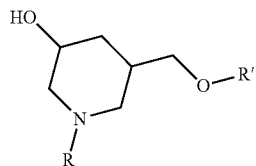

FORMULA F

In other embodiments, the linker for attaching a ligand to the 3' end of the sense strand of an RNAi construct of the invention has the following structure of Formula G, wherein R=ligand (e.g., moiety containing 3 to 4 GalNAc units) and R'=3' end of sense strand of a double stranded RNA molecule:

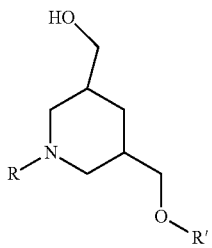

FORMULA G

In certain other embodiments, the linker for attaching a ligand to the 3' end of the sense strand of an RNAi construct of the invention has the following structure of Formula H, wherein R=ligand (e.g., moiety containing 3 to 4 GalNAc units) and R'=3' end of sense strand of a double stranded RNA molecule:

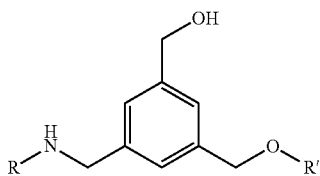

FORMULA H

In some embodiments, the linker for attaching a ligand to the 3' end of the sense strand of an RNAi construct of the invention has the following structure of Formula J, wherein R=ligand (e.g., moiety containing 3 to 4 GalNAc units) and R'=3' end of sense strand of a double stranded RNA molecule:

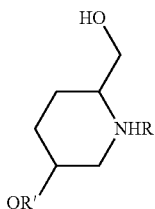

FORMULA J

In other embodiments, the linker for attaching a ligand to the 3' end of the sense strand of an RNAi construct of the invention has the following structure of Formula K, wherein R=ligand (e.g., moiety containing 3 to 4 GalNAc units) and R'=3' end of sense strand of a double stranded RNA molecule:

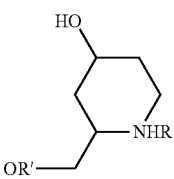

FORMULA K

Other types of linkers suitable for attaching ligands to the sense or antisense strands in the RNAi constructs of the invention are known in the art and can include the linkers described in U.S. Pat. Nos. 7,723,509; 8,017,762; 8,828,956; 8,877,917; and 9,181,551, all of which are hereby incorporated by reference in their entireties.

In certain embodiments, the ligand covalently attached to the sense or antisense strand of the RNAi constructs of the invention comprises a GalNAc moiety, e.g, a multivalent GalNAc moiety. In some embodiments, the multivalent GalNAc moiety is a trivalent GalNAc moiety and is attached to the 3' end of the sense strand. In other embodiments, the multivalent GalNAc moiety is a trivalent GalNAc moiety and is attached to the 5' end of the sense strand. In yet other embodiments, the multivalent GalNAc moiety is a tetravalent GalNAc moiety and is attached to the 3' end of the sense strand. In still other embodiments, the multivalent GalNAc moiety is a tetravalent GalNAc moiety and is attached to the 5' end of the sense strand. Exemplary trivalent and tetravalent GalNAc moieties and linkers that can be attached to the double-stranded RNA molecules in the RNAi constructs of the invention are provided in the structural formulas I-XXIX below.

In one embodiment, the RNAi construct comprises a ligand and linker having the following structure of Formula I, wherein each n is independently 1 to 3, k is 1 to 3, m is 1 or 2, j is 1 or 2, and the ligand is attached to the 3' end of the sense strand of the double-stranded RNA molecule (represented by the solid wavy line):

FORMULA I
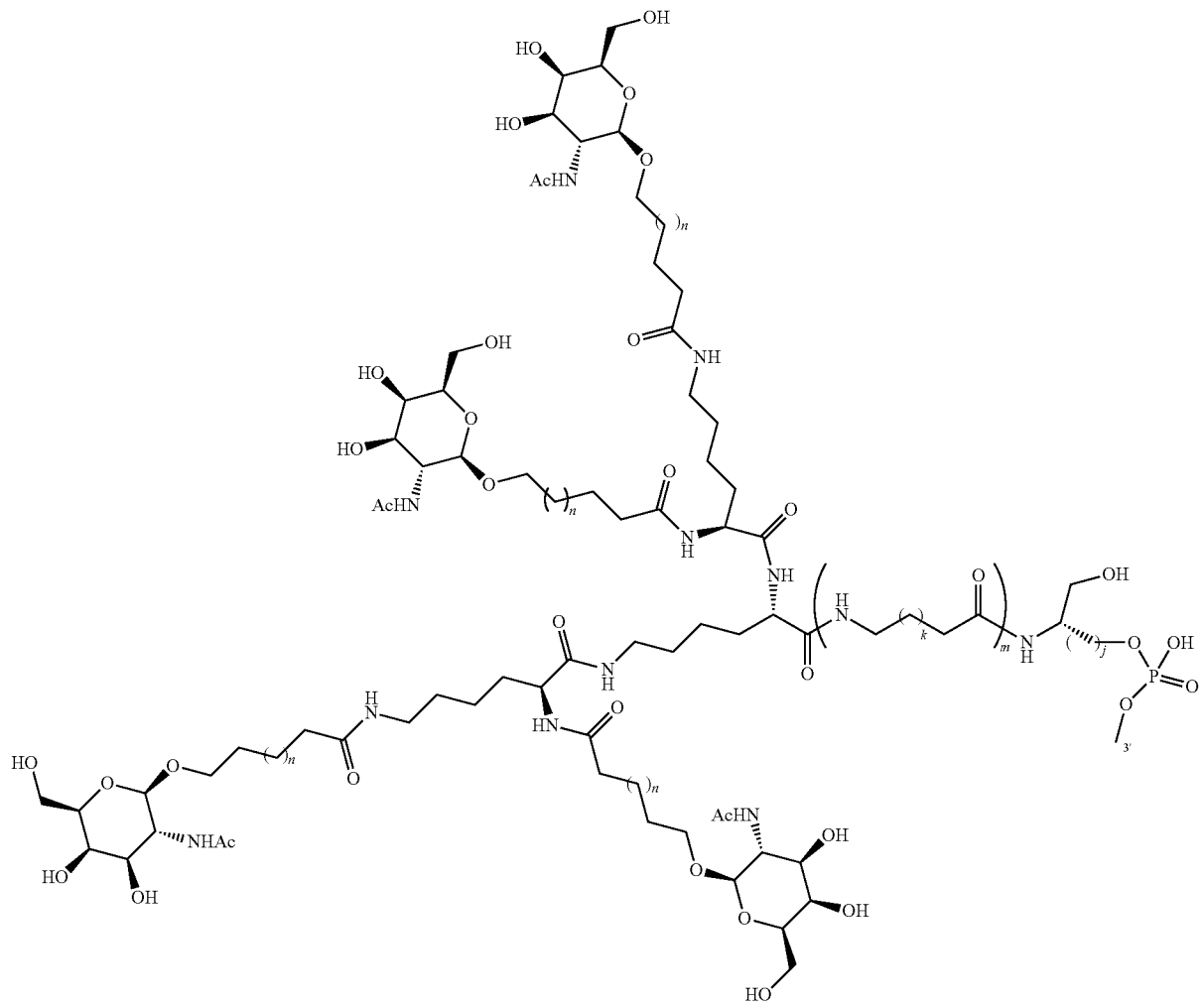
In another embodiment, the RNAi construct comprises a ligand and linker having the following structure of Formula II, wherein each n is independently 1 to 3, k is 1 to 3, m is 1 or 2, and the ligand is attached to the 3' end of the sense strand of the double-stranded RNA molecule (represented by the solid wavy line):

FORMULA II
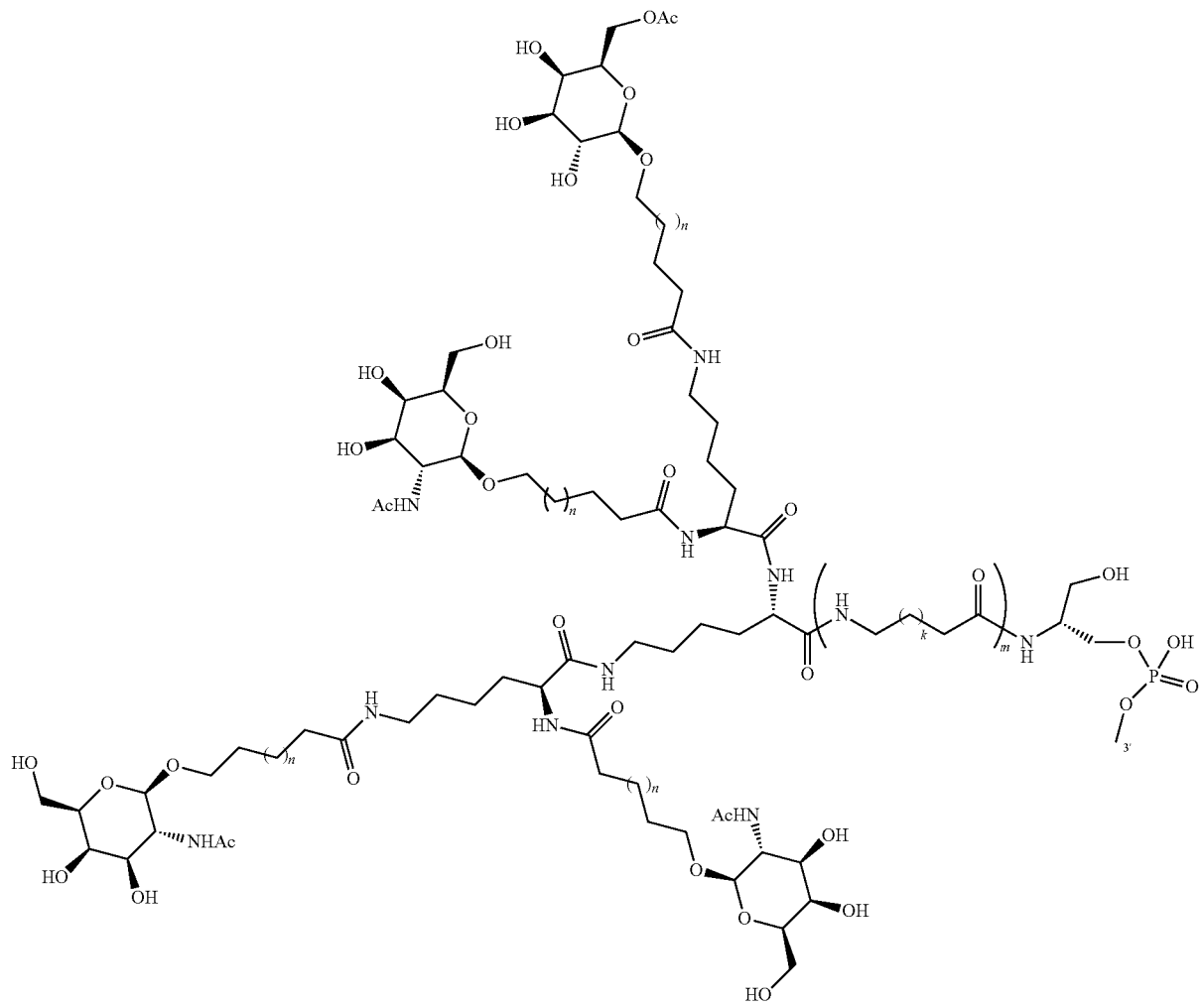
In yet another embodiment, the RNAi construct comprises a ligand and linker having the following structure of Formula III, wherein each n is independently 1 to 3, k is 1 to 3, m is 1 or 2, j is 1 or 2, and the ligand is attached to the 3' end of the sense strand of the double-stranded RNA molecule (represented by the solid wavy line):

FORMULA III
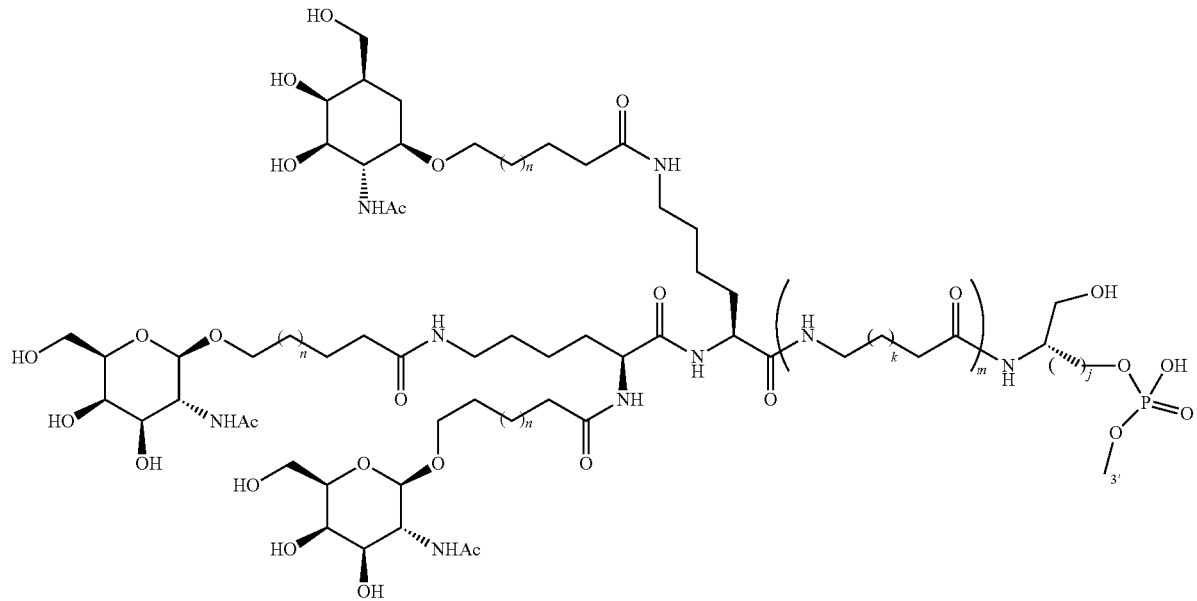
In still another embodiment, the RNAi construct comprises a ligand and linker having the following structure of Formula IV, wherein each n is independently 1 to 3, k is 1 to 3, m is 1 or 2, j is 1 or 2, and the ligand is attached to the 3' end of the sense strand of the double-stranded RNA molecule (represented by the solid wavy line):
FORMULA IV
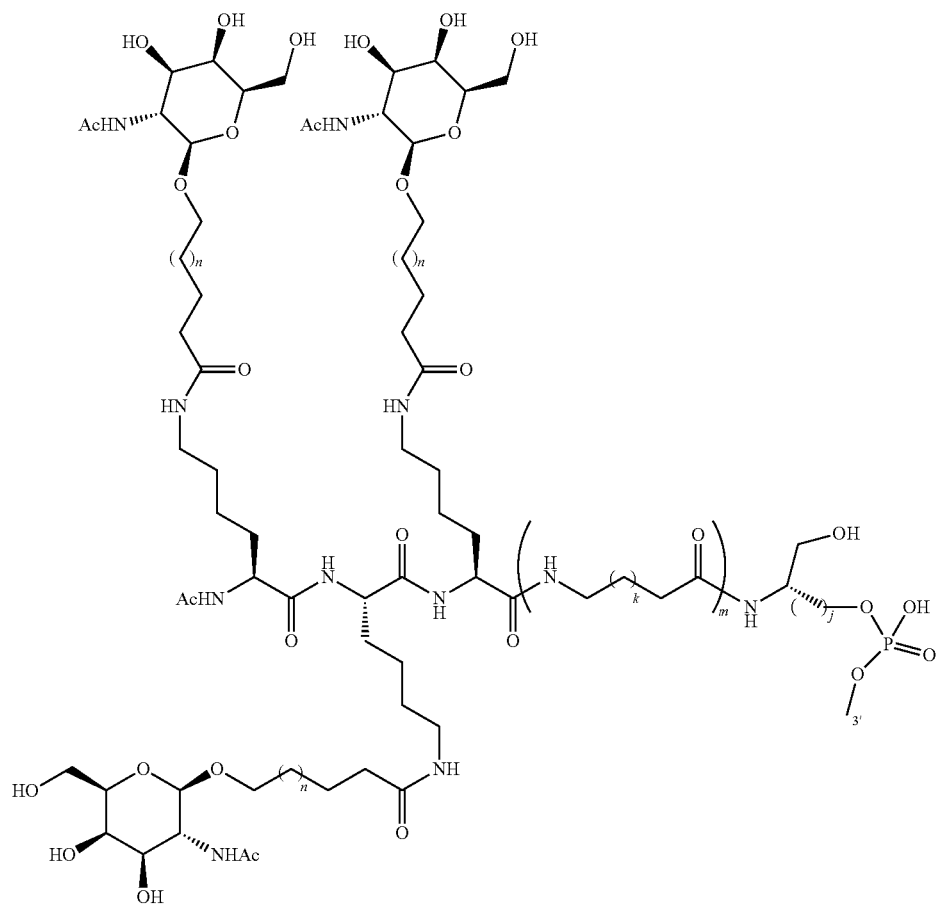

In still another embodiment, the RNAi construct comprises a ligand and linker having the following structure of Formula V, wherein each n is independently 1 to 3, k is 1 to 3, m is 1 or 2, j is 1 or 2, and the ligand is attached to the 3' end of the sense strand of the double-stranded RNA molecule (represented by the solid wavy line):

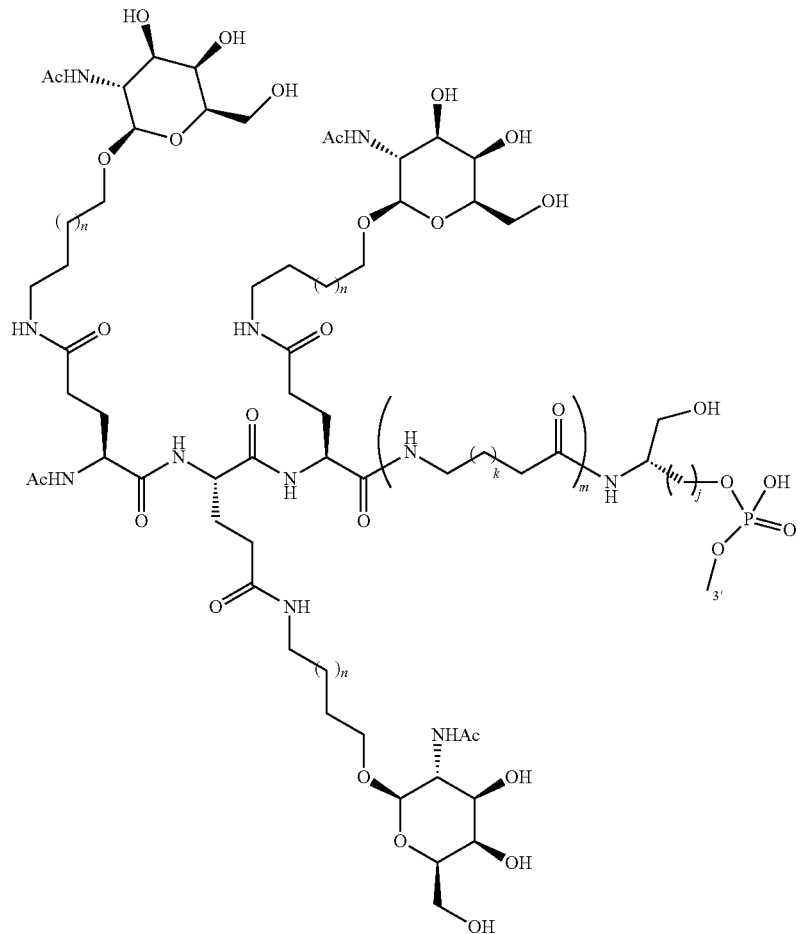

FORMULA V

In another embodiment, the RNAi construct comprises a ligand and linker having the following structure of Formula VI, wherein each n is independently 1 to 3, k is 1 to 3, m is 1 or 2, j is 1 or 2, and the ligand is attached to the 3' end of the sense strand of the double-stranded RNA molecule (represented by the solid wavy line):

FORMULA VI

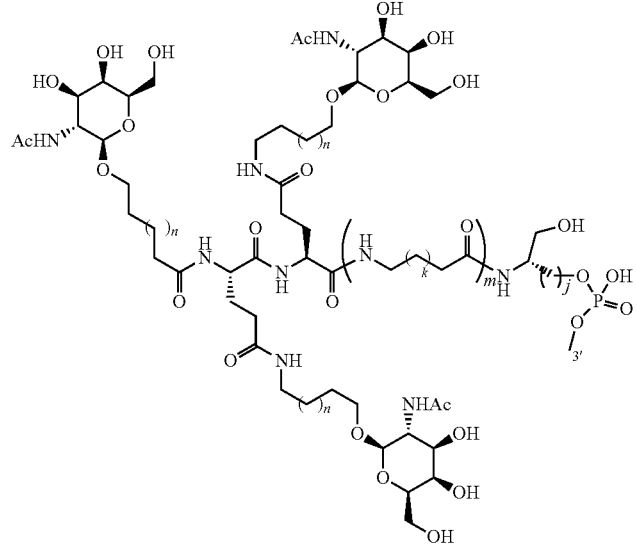

In one particular embodiment, the RNAi construct comprises a ligand and linker having the following structure of Formula VII, wherein the ligand is attached to the 3' end of the sense strand of the double-stranded RNA molecule (represented by the solid wavy line):

FORMULA VII

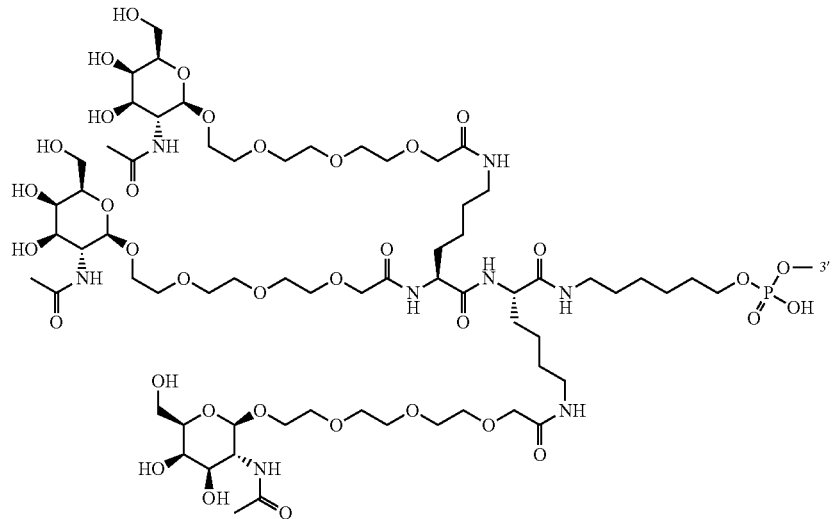

In another particular embodiment, the RNAi construct comprises a ligand and linker having the following structure of Formula VIII, wherein the ligand is attached to the 3' end of the sense strand of the double-stranded RNA molecule (represented by the solid wavy line):

FORMULA VIII

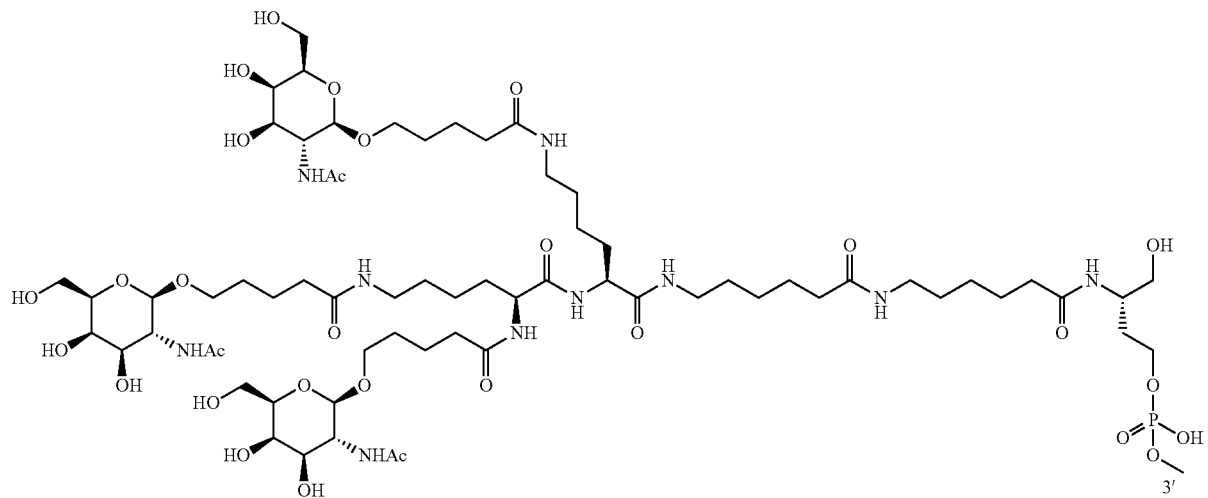

In certain embodiments, the RNAi construct comprises a ligand and linker having the following structure of Formula IX, wherein each n is independently 1 to 3, k is 1 to 3, m is 1 or 2, and the ligand is attached to the 3' end of the sense strand of the double-stranded RNA molecule (represented by the solid wavy line):

FORMULA IX

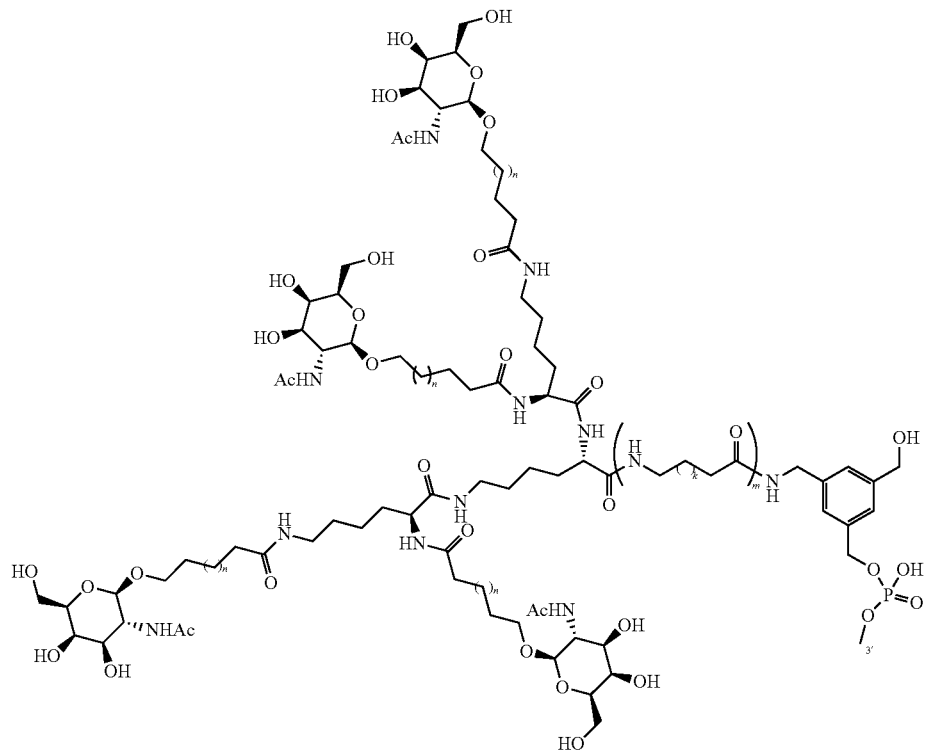

In other embodiments, the RNAi construct comprises a ligand and linker having the following structure of Formula X, wherein each n is independently 1 to 3, k is 1 to 3, m is 1 or 2, and the ligand is attached to the 3' end of the sense strand of the double-stranded RNA molecule (represented by the solid wavy line):

FORMULA X

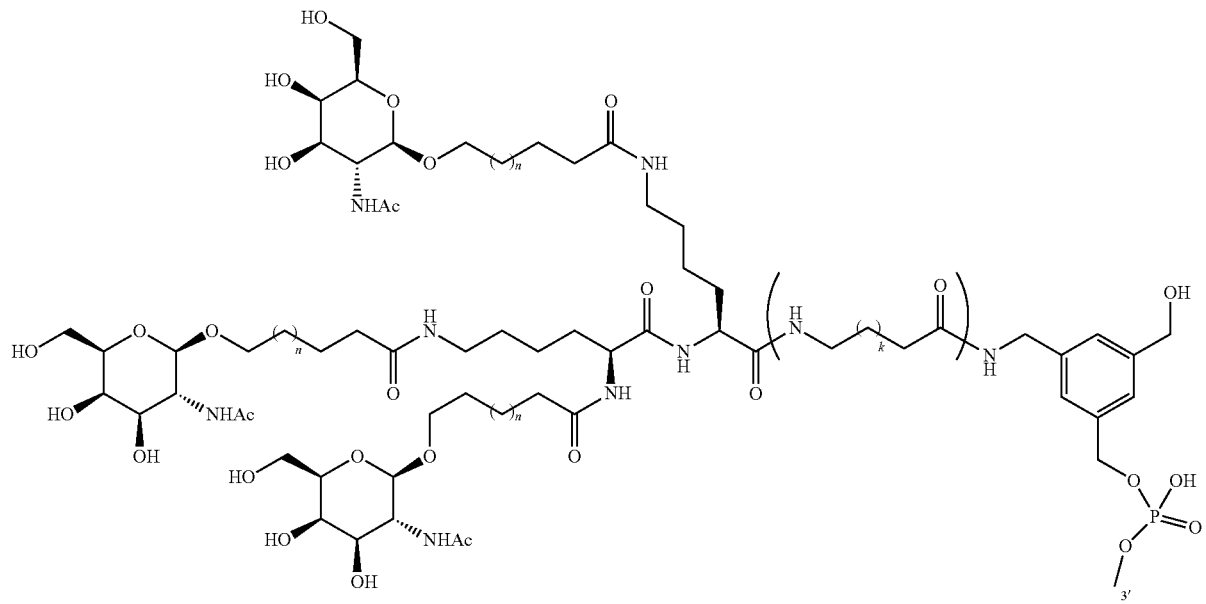

In one embodiment, the RNAi construct comprises a ligand and linker having the following structure of Formula XI, wherein each n is independently 1 to 3, k is 1 to 3, m is 1 or 2, and the ligand is attached to the 3' end of the sense strand of the double-stranded RNA molecule (represented by the solid wavy line):

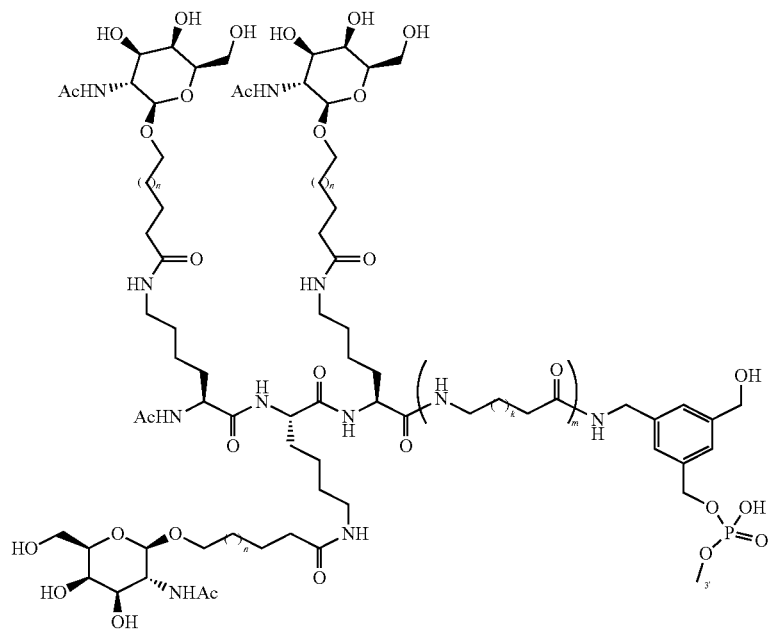

In another embodiment, the RNAi construct comprises a ligand and linker having the following structure of Formula XII, wherein each n is independently 1 to 3, k is 1 to 3, m is 1 or 2, and the ligand is attached to the 3' end of the sense strand of the double-stranded RNA molecule (represented by the solid wavy line):

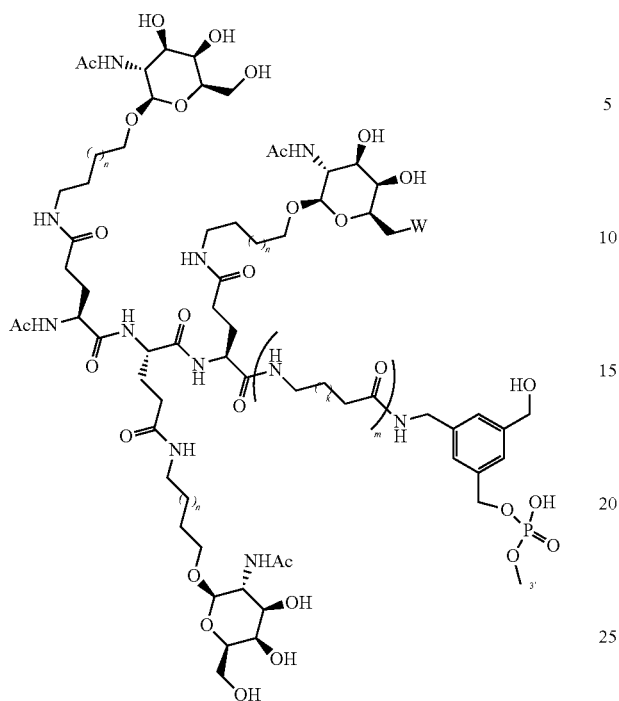
In yet another embodiment, the RNAi construct comprises a ligand and linker having the following structure of Formula XIII, wherein each n is independently 1 to 3, k is 1 to 3, m is 1 or 2, and the ligand is attached to the 3' end of the sense strand of the double-stranded RNA molecule (represented by the solid wavy line):
FORMULA XIII
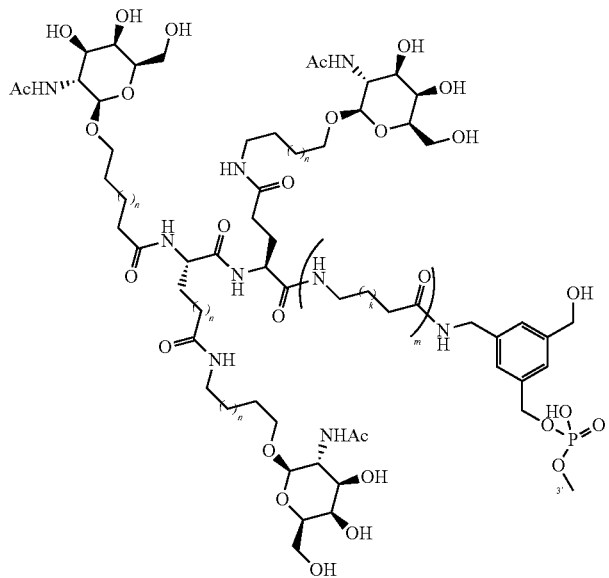

In certain embodiments, the RNAi construct comprises a ligand and linker having the following structure of Formula XIV, wherein each n is independently 1 to 3, k is 1 to 3, and the ligand is attached to the 5' end of the sense strand of the double-stranded RNA molecule (represented by the solid wavy line):

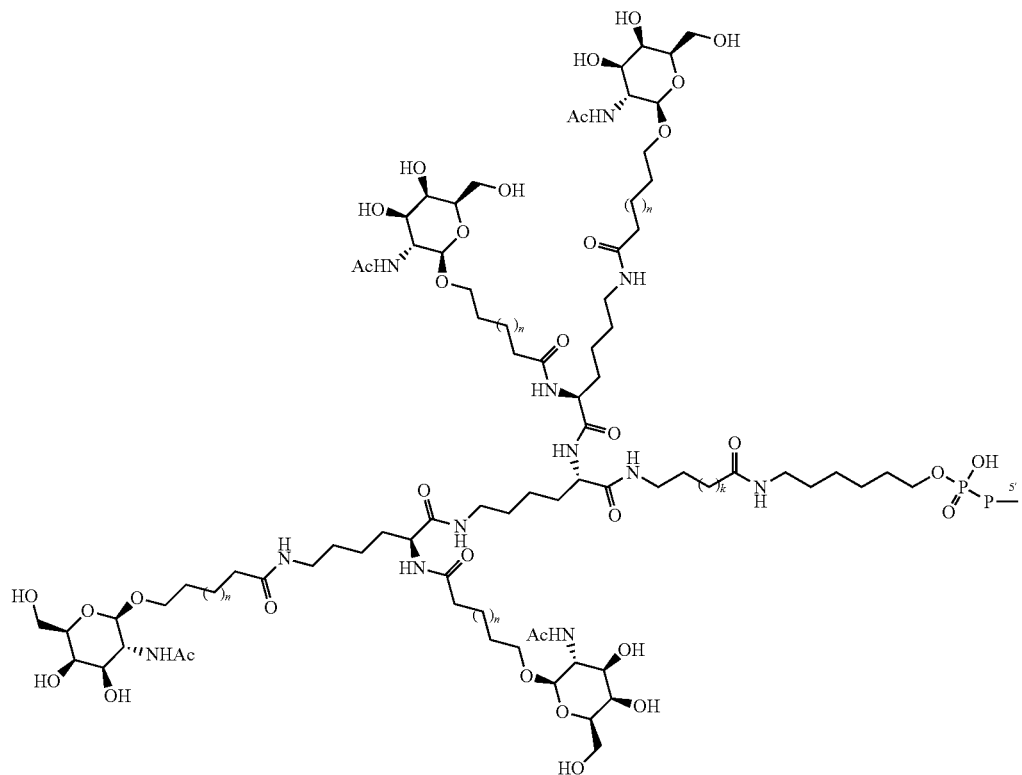

FORMULA XIV

In one embodiment, the RNAi construct comprises a ligand and linker having the following structure of Formula XV, wherein each n is independently 1 to 3 and the ligand is attached to the 5' end of the sense strand of the double-stranded RNA molecule (represented by the solid wavy line):

FORMULA XV

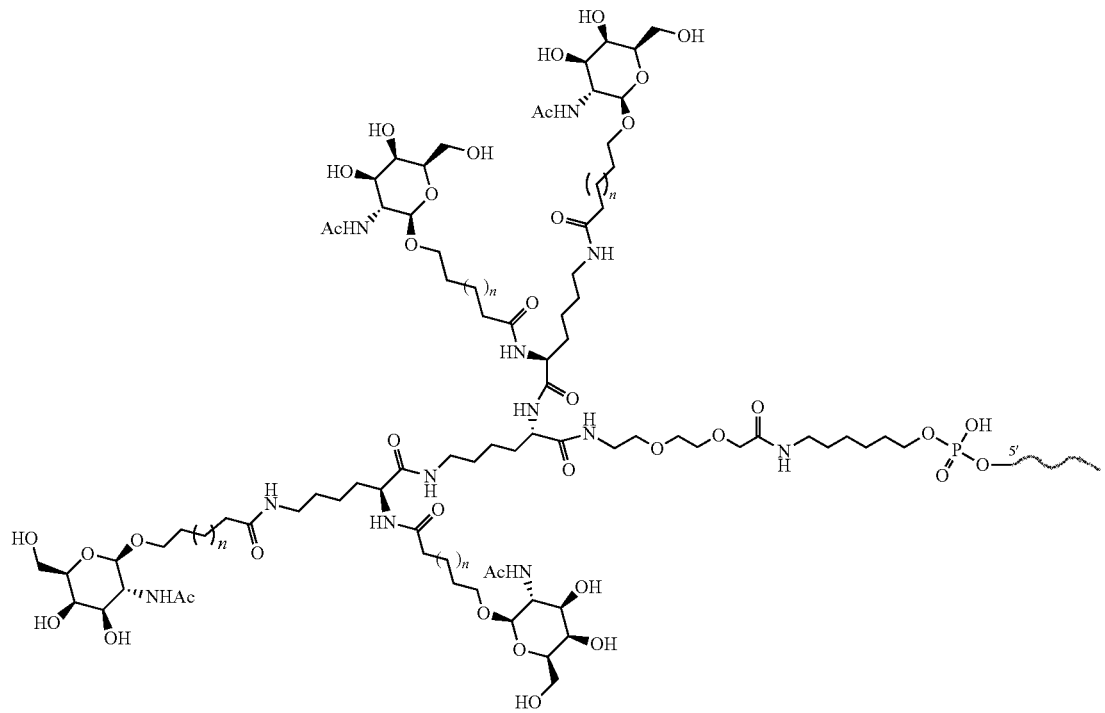

In other embodiments, the RNAi construct comprises a ligand and linker having the following structure of Formula XVI, wherein each n is independently 1 to 3, k is 1 to 3, and the ligand is attached to the 5' end of the sense strand of the double-stranded RNA molecule (represented by the solid wavy line):

FORMULA XVI

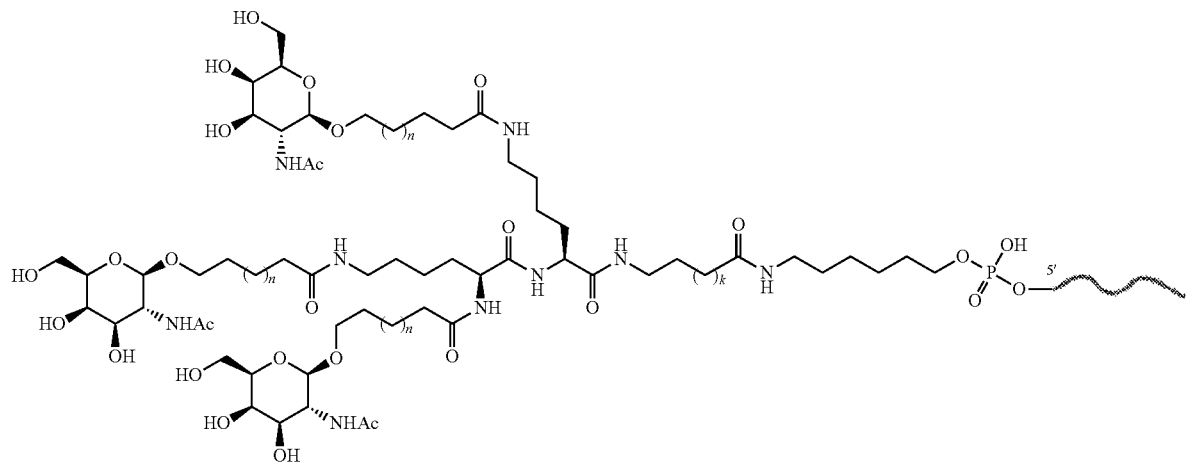

In one embodiment, the RNAi construct comprises a ligand and linker having the following structure of Formula XVII, wherein each n is independently 1 to 3 and the ligand is attached to the 5' end of the sense strand of the double-stranded RNA molecule (represented by the solid wavy line):

FORMULA XVII
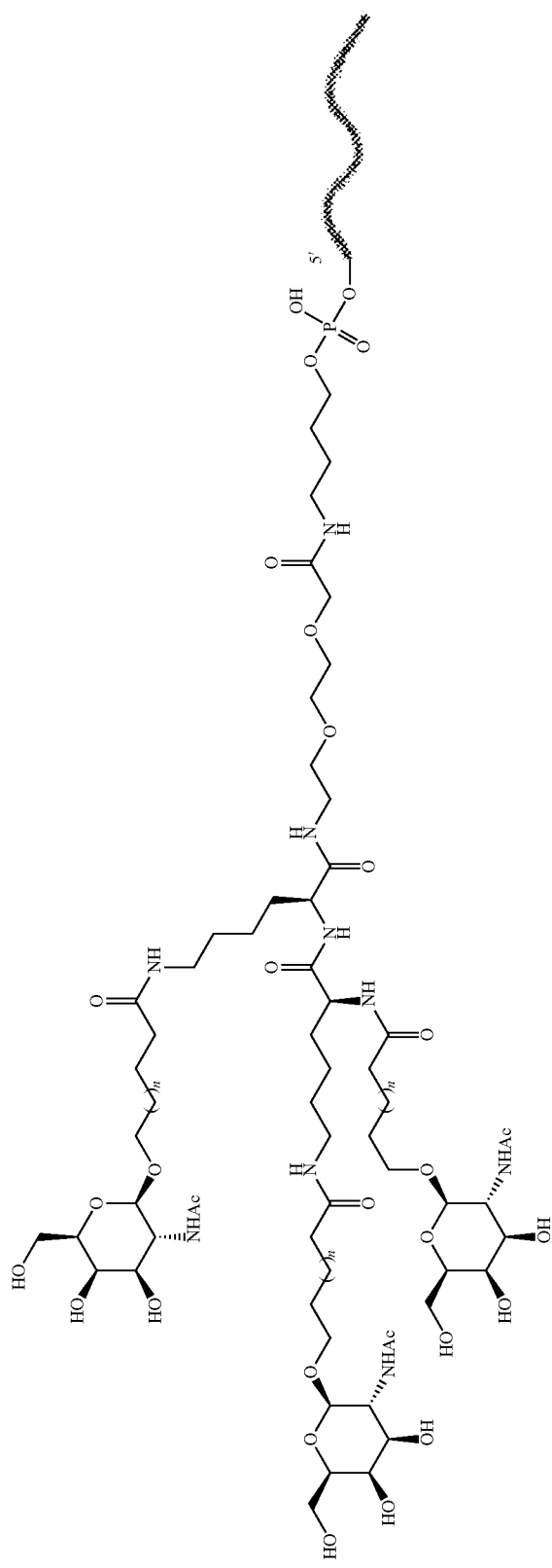

In certain other embodiments, the RNAi construct comprises a ligand and linker having the following structure of Formula XVIII, wherein each n is independently 1 to 3, k is 1 to 3, and the ligand is attached to the 5' end of the sense strand of the double-stranded RNA molecule (represented by the solid wavy line):

FORMULA XVIII

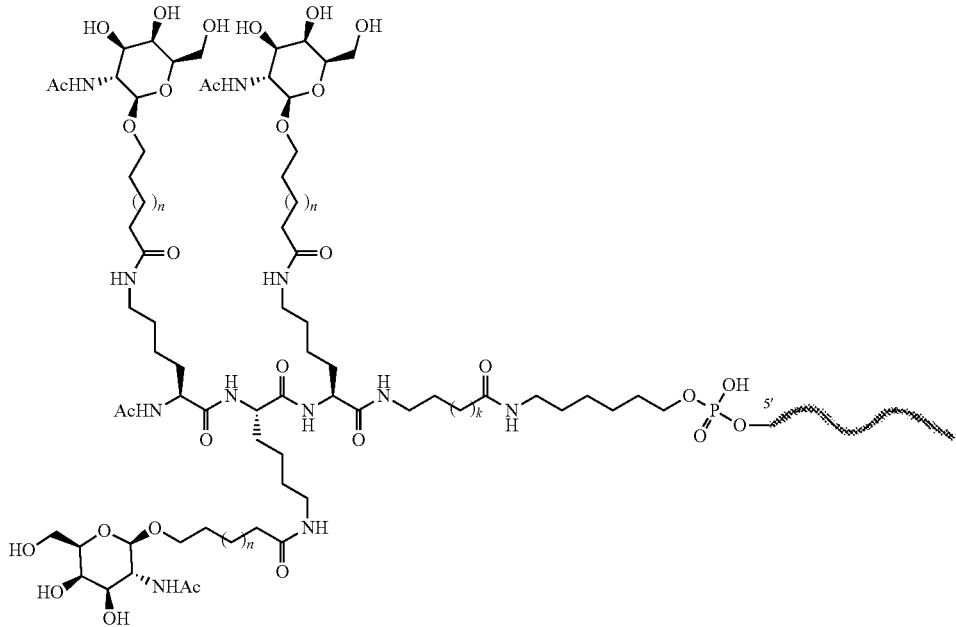

In one particular embodiment, the RNAi construct comprises a ligand and linker having the following structure of Formula XIX, wherein each n is independently 1 to 3 and the ligand is attached to the 5' end of the sense strand of the double-stranded RNA molecule (represented by the solid wavy line):

FORMULA XIX

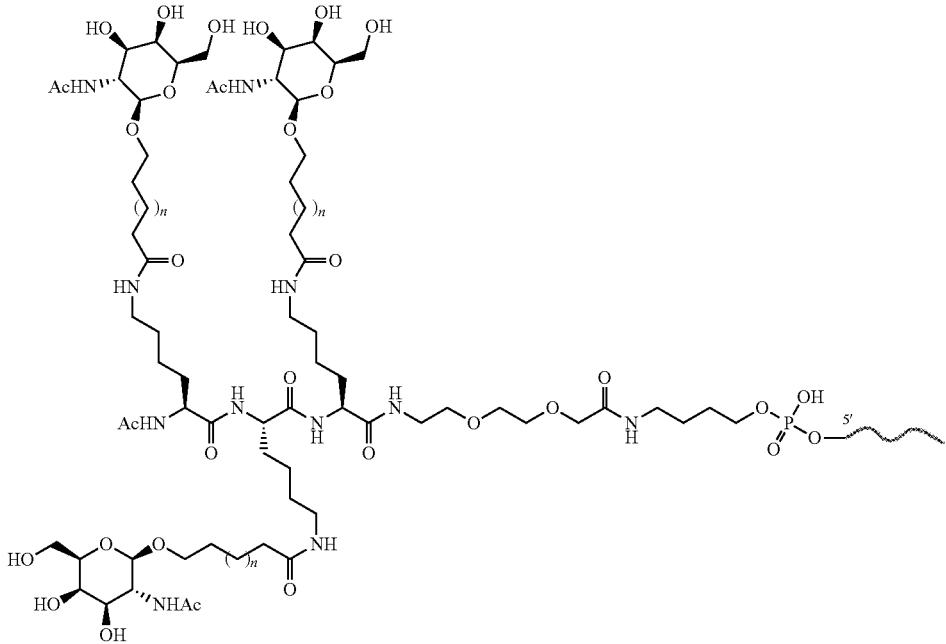

In some embodiments, the RNAi construct comprises a ligand and linker having the following structure of Formula XX, wherein each n is independently 1 to 3, k is 1 to 3, and the ligand is attached to the 5' end of the sense strand of the double-stranded RNA molecule (represented by the solid wavy line):

FORMULA XX

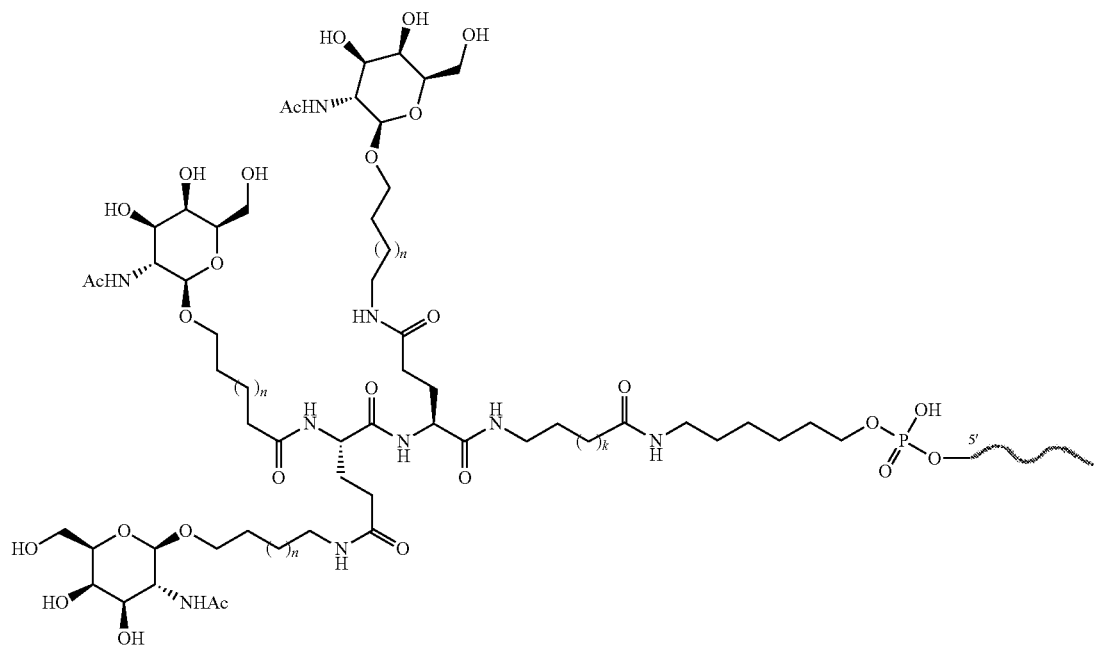

In one embodiment, the RNAi construct comprises a ligand and linker having the following structure of Formula XXI, wherein each n is independently 1 to 3, and the ligand is attached to the 5' end of the sense strand of the double-stranded RNA molecule (represented by the solid wavy line):

FORMULA XXI

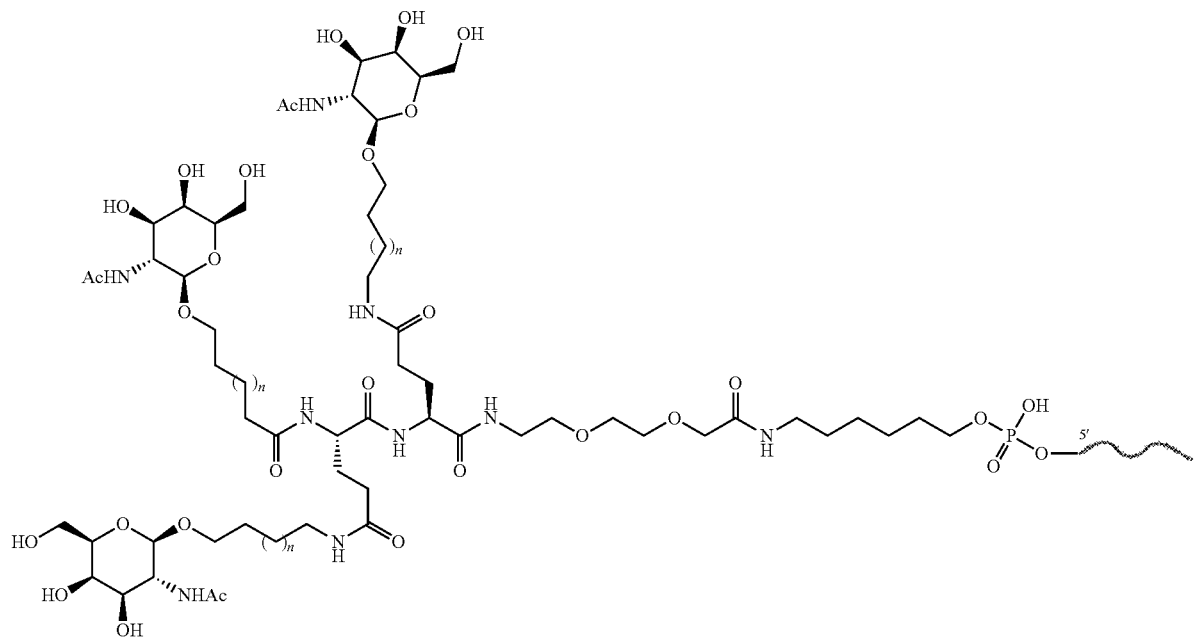

In certain embodiments, the RNAi construct comprises a ligand and linker having the following structure of Formula XXII, wherein each n is independently 1 to 3, k is 1 to 3, and the ligand is attached to the 5' end of the sense strand of the double-stranded RNA molecule (represented by the solid wavy line):

FORMULA XXII

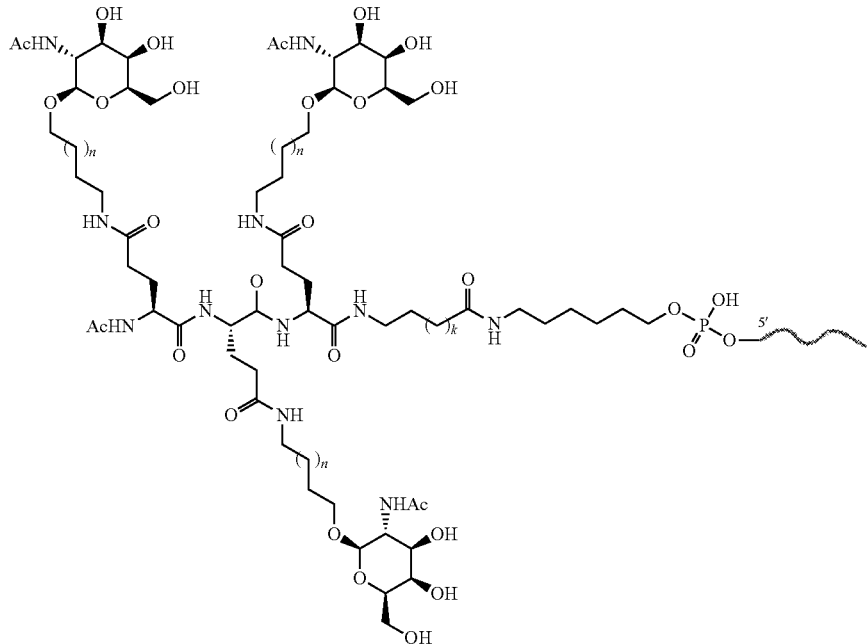

In one embodiment, the RNAi construct comprises a ligand and linker having the following structure of Formula XXIII, wherein each n is independently 1 to 3 and the ligand is attached to the 5' end of the sense strand of the double-stranded RNA molecule (represented by the solid wavy line):

FORMULA XXIII

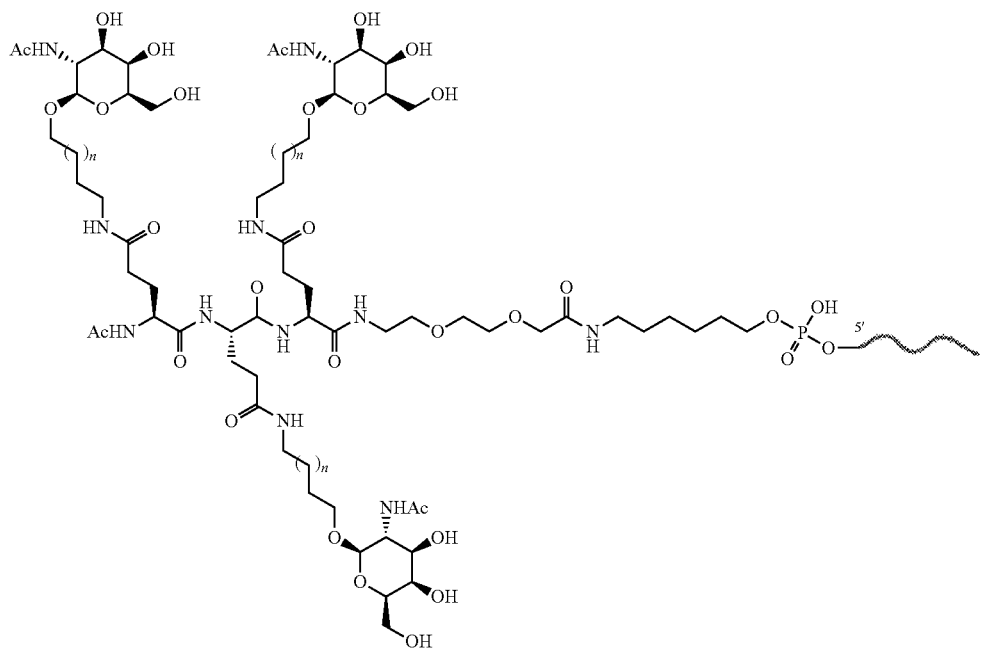

In certain other embodiments, the RNAi construct comprises a ligand and linker having the following structure of Formula XXIV, wherein each n is independently 1 to 3 and the ligand is attached to the 5' end of the sense strand of the double-stranded RNA molecule (represented by the solid wavy line):

FORMULA XXIV

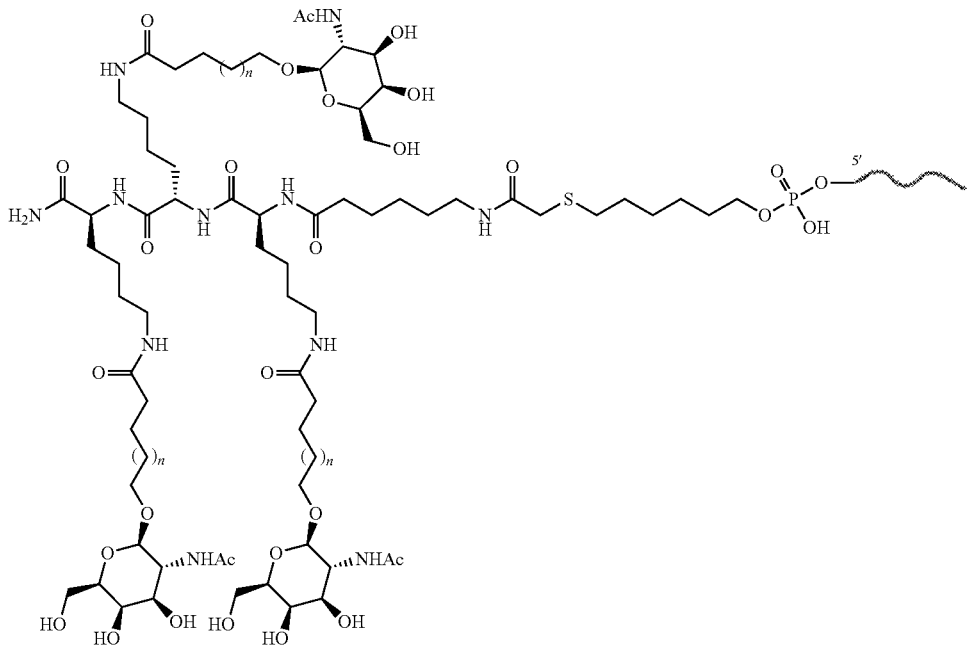

In another embodiment, the RNAi construct comprises a ligand and linker having the following structure of Formula XXV, wherein each n is independently 1 to 3 and the ligand is attached to the 5' end of the sense strand of the double-stranded RNA molecule (represented by the solid wavy line):

FORMULA XXV

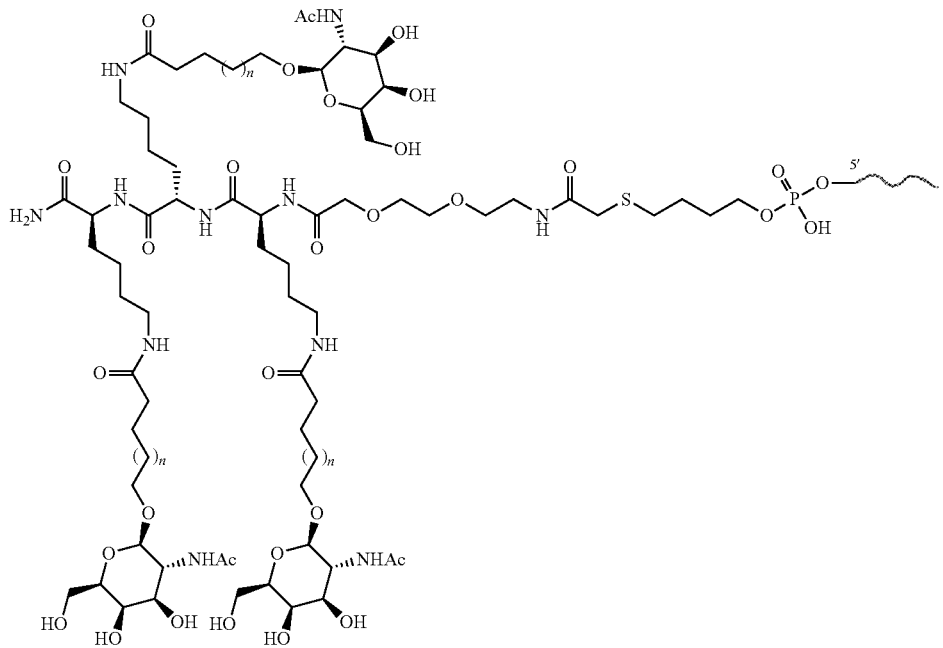

In certain embodiments, the RNAi construct comprises a ligand and linker having the following structure of Formula XXVI, wherein the ligand is attached to the 5' end of the sense strand of the double-stranded RNA molecule (represented by the solid wavy line):

FORMULA XXVI

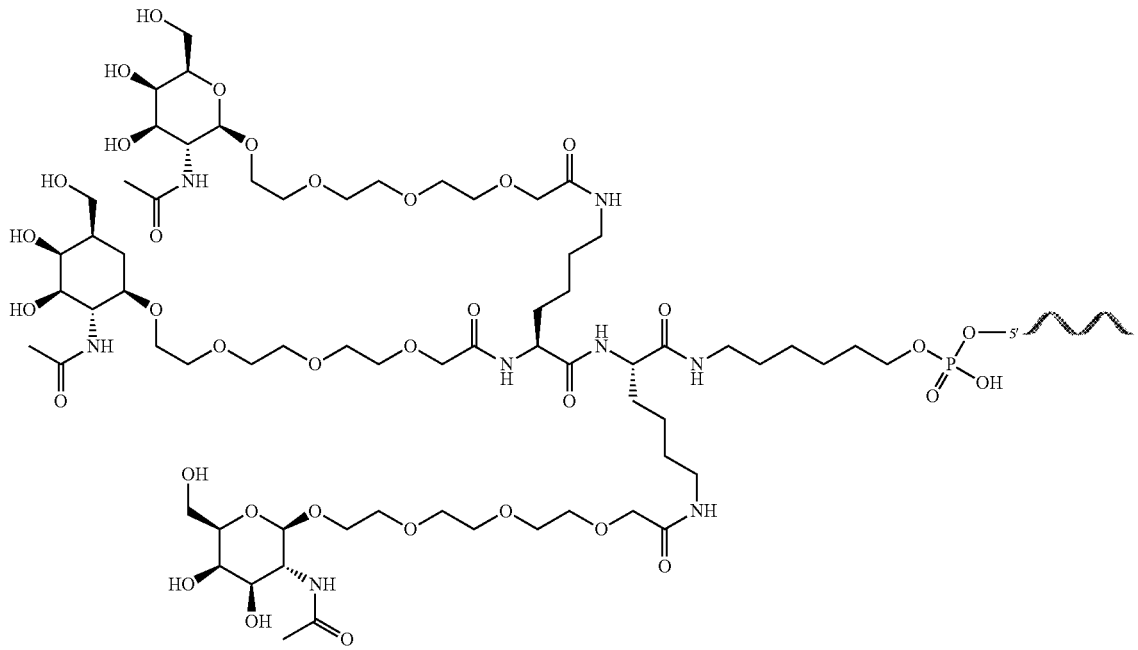

In one embodiment, the RNAi construct comprises a ligand and linker having the following structure of Formula XXVII, wherein each n is independently 1 to 3, k is 1 to 9, m is 1 or 2, and the ligand is attached to the 5' end of the sense strand of the double-stranded RNA molecule (represented by the solid wavy line):

FORMULA XXVII

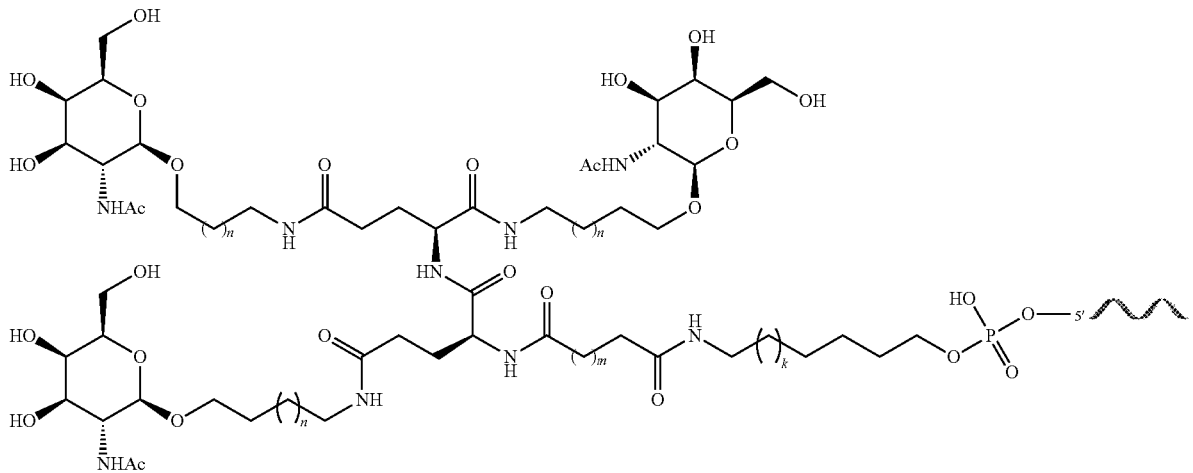

In another embodiment, the RNAi construct comprises a ligand and linker having the following structure of Formula XXVIII, wherein the ligand is attached to the 5' end of the sense strand of the double-stranded RNA molecule (represented by the solid wavy line):

FORMULA XXVIII

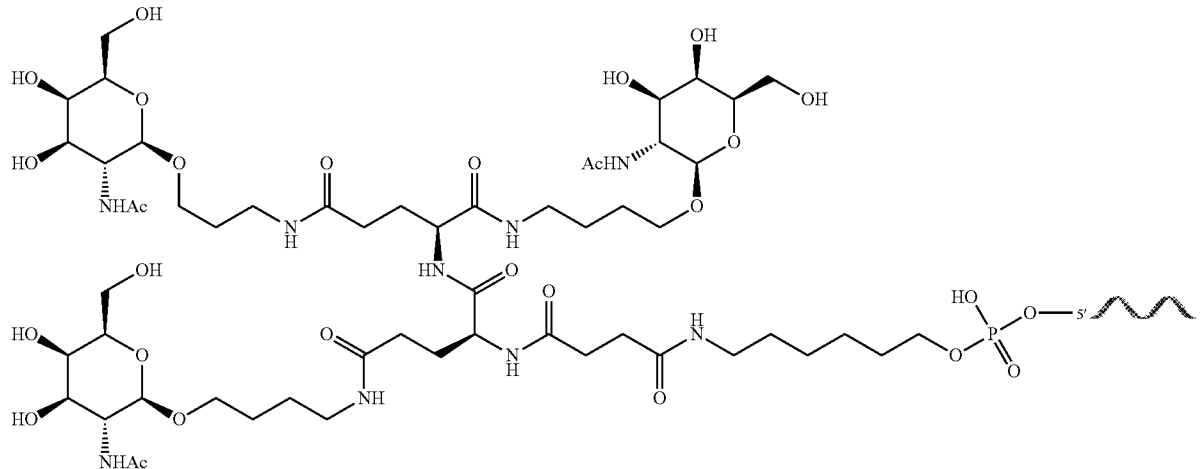

In one particular embodiment, the RNAi construct comprises a ligand and linker having the following structure of Formula XXIX, wherein the ligand is attached to the 3' end of the sense strand of the double-stranded RNA molecule (represented by the solid wavy line):

FORMULA XXIX

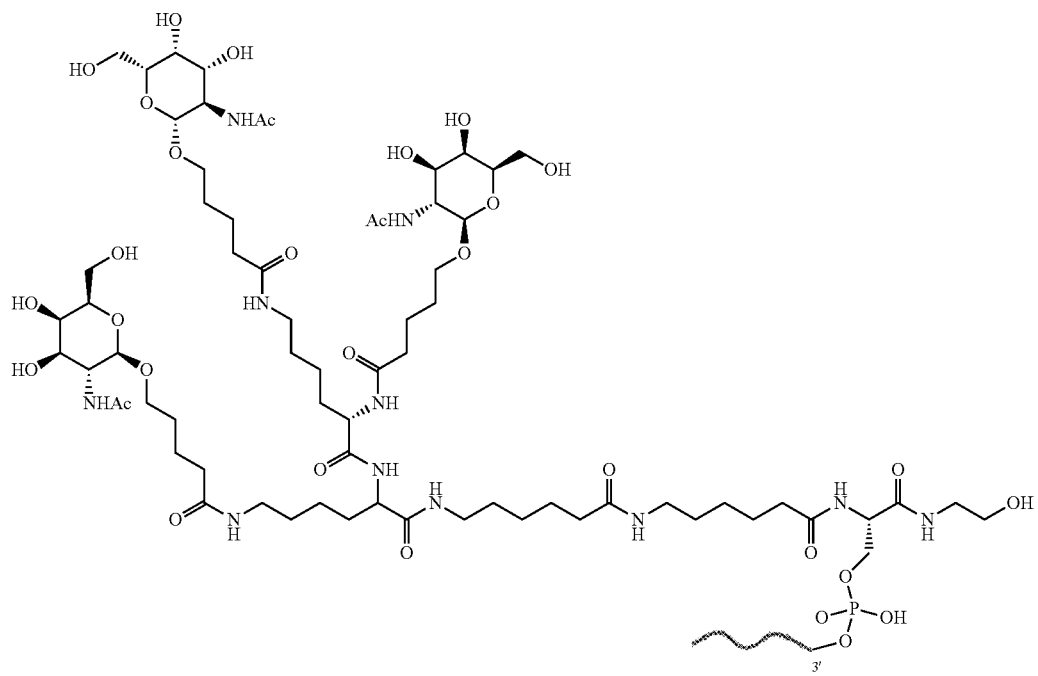

In some embodiments, the RNAi constructs of the invention may be delivered to a cell or tissue of interest by administering a vector that encodes and controls the intracellular expression of the RNAi construct. A "vector" (also referred to herein as an "expression vector) is a composition of matter which can be used to deliver a nucleic acid of interest to the interior of a cell. Numerous vectors are known in the art including, but not limited to, linear polynucleotides, polynucleotides associated with ionic or amphiphilic compounds, plasmids, and viruses. Thus, the term "vector" includes an autonomously replicating plasmid or a virus. Examples of viral vectors include, but are not limited to, adenoviral vectors, adeno-associated viral vectors, retroviral vectors, and the like. A vector can be replicated in a living cell, or it can be made synthetically.

Generally, a vector for expressing an RNAi construct of the invention will comprise one or more promoters operably linked to sequences encoding the RNAi construct. The phrase "operably linked" or "under transcriptional control" as used herein means that the promoter is in the correct location and orientation in relation to a polynucleotide sequence to control the initiation of transcription by RNA polymerase and expression of the polynucleotide sequence. A "promoter" refers to a sequence recognized by the synthetic machinery of the cell, or introduced synthetic machinery, required to initiate the specific transcription of a gene sequence. Suitable promoters include, but are not limited to, RNA pol I, pol II, H1 or U6 RNA pol III, and viral promoters (e.g. human cytomegalovirus (CMV) immediate early gene promoter, the SV40 early promoter, and the Rous sarcoma virus long terminal repeat). In some embodiments, a H1 or U6 RNA pol III promoter is preferred. The promoter can be a tissue-specific or inducible promoter. Of particular interest are liver-specific promoters, such as promoter sequences from human alpha 1-antitrypsin gene, albumin gene, hemopexin gene, and hepatic lipase gene. Inducible promoters include promoters regulated by ecdysone, estrogen, progesterone, tetracycline, and isopropyl-P-D1-thiogalactopyranoside (IPTG).

In some embodiments in which the RNAi construct comprises a siRNA, the two separate strands (sense and antisense strand) can be expressed from a single vector or two separate vectors. For example, in one embodiment, the sequence encoding the sense strand is operably linked to a promoter on a first vector and the sequence encoding the antisense strand is operably linked to a promoter on a second vector. In such an embodiment, the first and second vectors are co-introduced, e.g., by infection or transfection, into a target cell, such that the sense and antisense strands, once transcribed, will hybridize intracellularly to form the siRNA molecule. In another embodiment, the sense and antisense strands are transcribed from two separate promoters located in a single vector. In some such embodiments, the sequence encoding the sense strand is operably linked to a first promoter and the sequence encoding the antisense strand is operably linked to a second promoter, wherein the first and second promoters are located in a single vector. In one embodiment, the vector comprises a first promoter operably linked to a sequence encoding the siRNA molecule, and a second promoter operably linked to the same sequence in the opposite direction, such that transcription of the sequence from the first promoter results in the synthesis of the sense strand of the siRNA molecule and transcription of the sequence from the second promoter results in synthesis of the antisense strand of the siRNA molecule.

In other embodiments in which the RNAi construct comprises a shRNA, a sequence encoding the single, at least partially self-complementary RNA molecule is operably linked to a promoter to produce a single transcript. In some embodiments, the sequence encoding the shRNA comprises an inverted repeat joined by a linker polynucleotide sequence to produce the the stem and loop structure of the shRNA following transcription.

In some embodiments, the vector encoding an RNAi construct of the invention is a viral vector. Various viral vector systems that are suitable to express the RNAi constructs described herein include, but are not limited to, adenoviral vectors, retroviral vectors (e.g., lentiviral vectors, moloney murine leukemia virus), adeno-associated viral vectors; herpes simplex viral vectors; SV40 vectors; polyoma viral vectors; papilloma viral vectors; picornaviral vectors; and pox viral vectors (e.g. vaccinia virus). In certain embodiments, the viral vector is a retroviral vector (e.g. lentiviral vector).

Various vectors suitable for use in the invention, methods for inserting nucleic acid sequences encoding siRNA or shRNA molecules into vectors, and methods of delivering the vectors to the cells of interest are within the skill of those in the art. See, e.g., Dornburg, Gene Therap., Vol. 2: 301-310, 1995; Eglitis, Biotechniques, Vol. 6: 608-614, 1988; Miller, Hum Gene Therap., Vol. 1: 5-14, 1990; Anderson, Nature, Vol. 392: 25-30, 1998; Rubinson D A et al., Nat. Genet., Vol. 33: 401-406, 2003; Brummelkamp et al., Science, Vol. 296: 550-553, 2002; Brummelkamp et al., Cancer Cell, Vol. 2: 243-247, 2002; Lee et al., Nat Biotechnol, Vol. 20: 500-505, 2002; Miyagishi et al., Nat Biotechnol, Vol. 20: 497-500, 2002; Paddison et al., Genes Dev, Vol. 16: 948-958, 2002; Paul et al., Nat Biotechnol, Vol. 20: 505-508, 2002; Sui et al., Proc Natl Acad Sci USA, Vol. 99: 5515-5520, 2002; and Yu et al., Proc Natl Acad Sci USA, Vol. 99: 6047-6052, 2002, all of which are hereby incorporated by reference in their entireties.

The present invention also includes pharmaceutical compositions and formulations comprising the RNAi constructs described herein and pharmaceutically acceptable carriers, excipients, or diluents. Such compositions and formulations are useful for reducing expression of ASGR1 in a subject in need thereof. Where clinical applications are contemplated, pharmaceutical compositions and formulations will be prepared in a form appropriate for the intended application. Generally, this will entail preparing compositions that are essentially free of pyrogens, as well as other impurities that could be harmful to humans or animals.

The phrases "pharmaceutically acceptable" or "pharmacologically acceptable" refer to molecular entities and compositions that do not produce adverse, allergic, or other untoward reactions when administered to an animal or a human. As used herein, "pharmaceutically acceptable carrier, excipient, or diluent" includes solvents, buffers, solutions, dispersion media, coatings, antibacterial and antifungal agents, isotonic and absorption delaying agents and the like acceptable for use in formulating pharmaceuticals, such as pharmaceuticals suitable for administration to humans. The use of such media and agents for pharmaceutically active substances is well known in the art. Except insofar as any conventional media or agent is incompatible with the RNAi constructs of the present invention, its use in therapeutic compositions is contemplated. Supplementary active ingredients also can be incorporated into the compositions, provided they do not inactivate the vectors or RNAi constructs of the compositions.

Compositions and methods for the formulation of pharmaceutical compositions depend on a number of criteria, including, but not limited to, route of administration, type and extent of disease or disorder to be treated, or dose to be administered. In some embodiments, the pharmaceutical compositions are formulated based on the intended route of delivery. For instance, in certain embodiments, the pharmaceutical compositions are formulated for parenteral delivery. Parenteral forms of delivery include intravenous, intraarterial, subcutaneous, intrathecal, intraperitoneal or intramuscular injection or infusion. In one embodiment, the pharmaceutical composition is formulated for intravenous delivery. In such an embodiment, the pharmaceutical composition may include a lipid-based delivery vehicle. In another embodiment, the pharmaceutical composition is formulated for subcutaneous delivery. In such an embodiment, the pharmaceutical composition may include a targeting ligand (e.g. GalNAc-containing or antibody-containing ligands described herein).

In some embodiments, the pharmaceutical compositions comprise an effective amount of an RNAi construct described herein. An "effective amount" is an amount sufficient to produce a beneficial or desired clinical result. In some embodiments, an effective amount is an amount sufficient to reduce ASGR1 expression in hepatocytes of a subject. In some embodiments, an effective amount may be an amount sufficient to only partially reduce ASGR1 expression, for example, to a level comparable to expression of the wild-type ASGR1 allele in human heterozygotes. Human heterozygous carriers of loss of function ASGR1 variant alleles were reported to have lower serum levels of non-HDL cholesterol and a lower risk of coronary artery disease and myocardial infarction as compared to non-carriers (Nioi et al., New England Journal of Medicine, Vol. 374(22):2131-2141, 2016). Thus, without being bound by theory, it is believed that partial reduction of ASGR1 expression may be sufficient to achieve the benefical reduction of serum non-HDL cholesterol and reduction of risk of coronary artery disease and myocardial infarction.

An effective amount of an RNAi construct of the invention may be from about 0.01 mg/kg body weight to about 100 mg/kg body weight, about 0.05 mg/kg body weight to about 75 mg/kg body weight, about 0.1 mg/kg body weight to about 50 mg/kg body weight, about 1 mg/kg to about 30 mg/kg body weight, about 2.5 mg/kg of body weight to about 20 mg/kg body weight, or about 5 mg/kg body weight to about 15 mg/kg body weight. In certain embodiments, a single effective dose of an RNAi construct of the invention may be about 0.1 mg/kg, about 0.5 mg/kg, about 1 mg/kg, about 2 mg/kg, about 3 mg/kg, about 4 mg/kg, about 5 mg/kg, about 6 mg/kg, about 7 mg/kg, about 8 mg/kg, about 9 mg/kg, or about 10 mg/kg. The pharmaceutical composition comprising an effective amount of RNAi construct can be administered weekly, biweekly, monthly, quarterly, or biannually. The precise determination of what would be considered an effective amount and frequency of administration may be based on several factors, including a patient's size, age, and general condition, type of disorder to be treated (e.g. myocardial infarction, heart failure, coronary artery disease, hypercholesterolemia), particular RNAi construct employed, and route of administration. Estimates of effective dosages and in vivo half-lives for any particular RNAi construct of the invention can be ascertained using conventional methods and/or testing in appropriate animal models.

Administration of the pharmaceutical compositions of the present invention may be via any common route so long as the target tissue is available via that route. Such routes include, but are not limited to, parenteral (e.g., subcutaneous, intramuscular, intraperitoneal or intravenous), oral, nasal, buccal, intradermal, transdermal, and sublingual routes, or by direct injection into liver tissue or delivery through the hepatic portal vein. In some embodiments, the pharmaceutical composition is administered parenterally. For instance, in certain embodiments, the pharmaceutical composition is administered intravenously. In other embodiments, the pharmaceutical composition is administered subcutaneously.

Colloidal dispersion systems, such as macromolecule complexes, nanocapsules, microspheres, beads, and lipid-based systems, including oil-in-water emulsions, micelles, mixed micelles, and liposomes, may be used as delivery vehicles for the RNAi constructs of the invention or vectors encoding such constructs. Commercially available fat emulsions that are suitable for delivering the nucleic acids of the invention include Intralipid® (Baxter International Inc.), Liposyn® (Abbott Pharmaceuticals), Liposyn® II (Hospira), Liposyn® III (Hospira), Nutrilipid (B. Braun Medical Inc.), and other similar lipid emulsions. A preferred colloidal system for use as a delivery vehicle in vivo is a liposome (i.e., an artificial membrane vesicle). The RNAi constructs of the invention may be encapsulated within liposomes or may form complexes thereto, in particular to cationic liposomes. Alternatively, RNAi constructs of the invention may be complexed to lipids, in particular to cationic lipids. Suitable lipids and liposomes include neutral (e.g., dioleoylphosphatidyl ethanolamine (DOPE), dimyristoylphosphatidyl choline (DMPC), and dipalmitoyl phosphatidylcholine (DPPC)), distearolyphosphatidyl choline), negative (e.g., dimyristoylphosphatidyl glycerol (DMPG)), and cationic (e.g., dioleoyltetramethylaminopropyl (DOTAP) and dioleoylphosphatidyl ethanolamine (DOTMA)). The preparation and use of such colloidal disperson systems is well known in the art. Exemplary formulations are also disclosed in U.S. Pat. Nos. 5,981,505; 6,217,900; 6,383,512; 5,783,565; 7,202,227; 6,379,965; 6,127,170; 5,837,533; 6,747,014; and WO03/093449.

In some embodiments, the RNAi constructs of the invention are fully encapsulated in a lipid formulation, e.g., to form a SPLP, pSPLP, SNALP, or other nucleic acid-lipid particle. As used herein, the term "SNALP" refers to a stable nucleic acid-lipid particle, including SPLP. As used herein, the term "SPLP" refers to a nucleic acid-lipid particle comprising plasmid DNA encapsulated within a lipid vesicle. SNALPs and SPLPs typically contain a cationic lipid, a non-cationic lipid, and a lipid that prevents aggregation of the particle (e.g., a PEG-lipid conjugate). SNALPs and SPLPs are exceptionally useful for systemic applications, as they exhibit extended circulation lifetimes following intravenous injection and accumulate at distal sites (e.g., sites physically separated from the administration site). SPLPs include "pSPLP," which include an encapsulated condensing agent-nucleic acid complex as set forth in PCT Publication No. WO 00/03683. The nucleic acid-lipid particles typically have a mean diameter of about 50 nm to about 150 nm, about 60 nm to about 130 nm, about 70 nm to about 110 nm, or about 70 nm to about 90 nm, and are substantially nontoxic. In addition, the nucleic acids when present in the nucleic acid-lipid particles are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; and PCT Publication No. WO 96/40964.

The pharmaceutical compositions suitable for injectable use include, for example, sterile aqueous solutions or dispersions and sterile powders for the extemporaneous preparation of sterile injectable solutions or dispersions. Generally, these preparations are sterile and fluid to the extent that easy injectability exists. Preparations should be stable under the conditions of manufacture and storage and should be preserved against the contaminating action of microorganisms, such as bacteria and fungi. Appropriate solvents or dispersion media may contain, for example, water, ethanol, polyol (for example, glycerol, propylene glycol, and liquid polyethylene glycol, and the like), suitable mixtures thereof, and vegetable oils. The proper fluidity can be maintained, for example, by the use of a coating, such as lecithin, by the maintenance of the required particle size in the case of dispersion and by the use of surfactants. The prevention of the action of microorganisms can be brought about by various antibacterial an antifungal agents, for example, parabens, chlorobutanol, phenol, sorbic acid, thimerosal, and the like. In many cases, it will be preferable to include isotonic agents, for example, sugars or sodium chloride. Prolonged absorption of the injectable compositions can be brought about by the use in the compositions of agents delaying absorption, for example, aluminum monostearate and gelatin.

Sterile injectable solutions may be prepared by incorporating the active compounds in an appropriate amount into a solvent along with any other ingredients (for example as enumerated above) as desired, followed by filtered sterilization. Generally, dispersions are prepared by incorporating the various sterilized active ingredients into a sterile vehicle which contains the basic dispersion medium and the desired other ingredients, e.g., as enumerated above. In the case of sterile powders for the preparation of sterile injectable solutions, the preferred methods of preparation include vacuum-drying and freeze-drying techniques which yield a powder of the active ingredient(s) plus any additional desired ingredient from a previously sterile-filtered solution thereof.

The compositions of the present invention generally may be formulated in a neutral or salt form. Pharmaceutically-acceptable salts include, for example, acid addition salts (formed with free amino groups) derived from inorganic acids (e.g., hydrochloric or phosphoric acids), or from organic acids (e.g., acetic, oxalic, tartaric, mandelic, and the like). Salts formed with the free carboxyl groups can also be derived from inorganic bases (e.g., sodium, potassium, ammonium, calcium, or ferric hydroxides) or from organic bases (e.g., isopropylamine, trimethylamine, histidine, procaine and the like).

For parenteral administration in an aqueous solution, for example, the solution generally is suitably buffered and the liquid diluent first rendered isotonic for example with sufficient saline or glucose. Such aqueous solutions may be used, for example, for intravenous, intramuscular, subcutaneous and intraperitoneal administration. Preferably, sterile aqueous media are employed as is known to those of skill in the art, particularly in light of the present disclosure. By way of illustration, a single dose may be dissolved in 1 ml of isotonic NaCl solution and either added to 1000 ml of hypodermoclysis fluid or injected at the proposed site of infusion, (see for example, "Remington's Pharmaceutical Sciences" 15th Edition, pages 1035-1038 and 1570-1580). For human administration, preparations should meet sterility, pyrogenicity, general safety and purity standards as required by FDA standards. In certain embodiments, a pharmaceutical composition of the invention comprises or consists of a sterile saline solution and an RNAi construct described herein. In other embodiments, a pharmaceutical composition of the invention comprises or consists of an RNAi construct described herein and sterile water (e.g. water for injection, WFI). In still other embodiments, a pharmaceutical composition of the invention comprises or consists of an RNAi construct described herein and phosphate-buffered saline (PBS).

In some embodiments, the pharmaceutical compositions of the invention are packaged with or stored within a device for administration. Devices for injectable formulations include, but are not limited to, injection ports, pre-filled syringes, autoinjectors, injection pumps, on-body injectors, and injection pens. Devices for aerosolized or powder formulations include, but are not limited to, inhalers, insufflators, aspirators, and the like. Thus, the present invention includes administration devices comprising a pharmaceutical composition of the invention for treating or preventing one or more of the disorders described herein.

The present invention provides methods for reducing or inhibiting expression of ASGR1 in a subject in need thereof as well as methods of treating or preventing conditions, diseases, or disorders associated with ASGR1 expression or activity. A "condition, disease, or disorder associated with ASGR1 expression" refers to conditions, diseases, or disorders in which ASGR1 expression levels are altered or where elevated expression levels of ASGR1 are associated with an increased risk of developing the condition, disease or disorder. A condition, disease, or disorder associated with ASGR1 expression can also include conditions, diseases, or disorders resulting from aberrant changes in lipoprotein metabolism, such as changes resulting in abnormal levels of cholesterol, lipids, triglycerides, etc. or impaired clearance of these molecules. Recently, human carriers of loss of function variant alleles of the ASGR1 subunit of the asialoglycoprotein receptor were reported to have lower serum levels of non-HDL cholesterol and a lower risk of coronary artery disease and myocardial infarction as compared to non-carriers (Nioi et al., New England Journal of Medicine, Vol. 374(22):2131-2141, 2016, which is hereby incorporated by reference in its entirety). Thus, in certain embodiments, the RNAi constructs of the invention are particularly useful for treating or preventing cardiovascular disease (e.g. coronary artery disease and myocardial infarction) and cholesterol-related disorders (e.g. hypercholesterolemia).

Conditions, diseases, and disorders associated with ASGR1 expression that can be treated or prevented according to the methods of the invention include, but are not limited to, cardiovascular disease, such as myocardial infarction, heart failure, stroke (ischemic and hemorrhagic), atherosclerosis, coronary artery disease, peripheral vascular disease (e.g. peripheral artery disease), vulnerable plaque, hypercholesterolemia, and dyslipidemia (manifesting, e.g., as elevated total cholesterol, elevated low-density lipoprotein (LDL), elevated very low-density lipoprotein (VLDL), elevated triglycerides, and/or low levels of high-density lipoprotein (HDL)).

In certain embodiments, the present invention provides a method for reducing the expression of ASGR1 in a patient in need thereof comprising administering to the patient any of the RNAi constructs described herein. The term "patient," as used herein, refers to a mammal, including humans, and can be used interchangeably with the term "subject." Preferably, the expression level of ASGR1 in hepatocytes in the patient is reduced following administration of the RNAi construct as compared to the ASGR1 expression level in a patient not receiving the RNAi construct.

In some embodiments, a patient in need of reduction of ASGR1 expression is a patient who is at risk of having a myocardial infarction. A patient who is at risk of having a myocardial infarction may be a patient who has a history of myocardial infarction (e.g. has had a previous myocardial infarction). A patient at risk of having a myocardial infarction may also be a patient who has a familial history of myocardial infarction or who has one or more risk factors of myocardial infarction. Such risk factors include, but are not limited to, hypertension, elevated levels of non-HDL cholesterol, elevated levels of triglycerides, diabetes, obesity, or history of autoimmune diseases (e.g. rheumatoid arthritis, lupus). In one embodiment, a patient who is at risk of having a myocardial infarction is a patient who has or is diagnosed with coronary artery disease. The risk of myocardial infarction in these and other patients can be reduced by administering to the patients any of the RNAi constructs described herein. Accordingly, the present invention provides a method for reducing the risk of myocardial infarction in a patient in need thereof comprising administering to the patient an RNAi construct described herein. In some embodiments, the present invention includes use of any of the RNAi constructs described herein in the preparation of a medicament for reducing the risk of myocardial infarction in a patient in need thereof. In other embodiments, the present invention provides an ASGR1-targeting RNAi construct for use in a method for reducing the risk of myocardial infarction in a patient in need thereof.

In certain embodiments, a patient in need of reduction of ASGR1 expression is a patient who is diagnosed with or at risk of cardiovascular disease. Thus, the present invention includes a method for treating or preventing cardiovascular disease in a patient in need thereof by administering any of the RNAi constructs of the invention. In some embodiments, the present invention includes use of any of the RNAi constructs described herein in the preparation of a medicament for treating or preventing cardiovascular disease in a patient in need thereof. In other embodiments, the present invention provides an ASGR1-targeting RNAi construct for use in a method for treating or preventing cardiovascular disease in a patient in need thereof. Cardiovascular disease includes myocardial infarction, heart failure, stroke (ischemic and hemorrhagic), atherosclerosis, coronary artery disease, peripheral vascular disease (e.g. peripheral artery disease), and vulnerable plaque. In some embodiments, the cardiovascular disease to be treated or prevented according to the methods of the invention is coronary artery disease. In other embodiments, the cardiovascular disease to be treated or prevented according to the methods of the invention is myocardial infarction. In certain embodiments, administration of the RNAi constructs described herein reduces the risk of non-fatal myocardial infarctions, fatal and non-fatal strokes, certain types of heart surgery (e.g. angioplasty, bypass), hospitalization for heart failure, chest pain in patients with heart disease, and/or cardiovascular events in patients with established heart disease (e.g. prior myocardial infarction, prior heart surgery, and/or chest pain with evidence of blocked arteries). In some embodiments, administration of the RNAi constructs described herein according to the methods of the invention can be used to reduce the risk of recurrent cardiovascular events.

In certain other embodiments, a patient in need of reduction of ASGR1 expression is a patient who has elevated levels of non-HDL cholesterol. Accordingly, in some embodiments, the present invention provides a method for reducing non-HDL cholesterol in a patient in need thereof by administering to the patient any of the RNAi constructs described herein. In some embodiments, the present invention includes use of any of the RNAi constructs described herein in the preparation of a medicament for reducing non-HDL cholesterol in a patient in need thereof. In other embodiments, the present invention provides an ASGR1-targeting RNAi construct for use in a method for reducing non-HDL cholesterol in a patient in need thereof. Non-HDL cholesterol is a measure of all cholesterol-containing proatherogenic lipoproteins, including LDL cholesterol, very low-density lipoprotein, intermediate-density lipoprotein, lipoprotein(a), chylomicron, and chylomicron remnants. Non-HDL cholesterol has been reported to be a good predictor of cardiovascular risk (Rana et al., Curr. Atheroscler. Rep., Vol. 14:130-134, 2012). Non-HDL cholesterol levels can be calculated by subtracting HDL cholesterol levels from total cholesterol levels. In one embodiment, a patient's LDL cholesterol levels are reduced following administration of the RNAi construct. In another embodiment, a patient's lipoprotein (a) levels are reduced following administration of the RNAi construct.

In some embodiments, a patient to be treated according to the methods of the invention is a patient who has elevated levels of non-HDL cholesterol (e.g. elevated serum levels of non-HDL cholesterol). Ideally, levels of non-HDL cholesterol should be about 30 mg/dL above the target for LDL cholesterol levels for any given patient. In particular embodiments, a patient is administered an RNAi construct of the invention if the patient has a non-HDL cholesterol level of about 130 mg/dL or greater. In one embodiment, a patient is administered an RNAi construct of the invention if the patient has a non-HDL cholesterol level of about 160 mg/dL or greater. In another embodiment, a patient is administered an RNAi construct of the invention if the patient has a non-HDL cholesterol level of about 190 mg/dL or greater. In still another embodiment, a patient is administered an RNAi construct of the invention if the patient has a non-HDL cholesterol level of about 220 mg/dL or greater. In certain embodiments, a patient is administered an RNAi construct of the invention if the patient is at a high or very high risk of cardiovascular disease according to the 2013 ACC/AHA Guideline on the Assessment of Cardiovascular Risk (Goff et al., ACC/AHA guideline on the assessment of cardiovascular risk: a report of the American College of Cardiology/American Heart Association Task Force on Practice Guidelines. *Circulation.* 2013; 00:000-000) and has a non-HDL cholesterol level of about 100 mg/dL or greater.

In some embodiments of the methods of the invention, a patient is administered an RNAi construct described herein if they are at a moderate risk or higher for cardiovascular disease according to the 2013 ACC/AHA Guideline on the Assessment of Cardiovascular Risk (referred to herein as the "2013 Guidelines"). In certain embodiments, an RNAi construct of the invention is administered to a patient if the patient's LDL cholesterol level is greater than about 160 mg/dL. In other embodiments, an RNAi construct of the invention is administered to a patient if the patient's LDL cholesterol level is greater than about 130 mg/dL and the patient has a moderate risk of cardiovascular disease according to the 2013 Guidelines. In still other embodiments, an RNAi construct of the invention is administered to a patient if the patient's LDL cholesterol level is greater than 100 mg/dL and the patient has a high or very high risk of cardiovascular disease according to the 2013 Guidelines.

In certain embodiments, a patient to be treated according to the methods of the invention is a patient who has a vulnerable plaque (also referred to as unstable plaque). Vulnerable plaques are a build-up of macrophages and lipids containing predominantly cholesterol that lie underneath the endothelial lining of the arterial wall. These vulnerable plaques can rupture resulting in the formation of a blood clot, which can potentially block blood flow through the artery and cause a myocardial infarction or stroke. Vulnerable plaques can be identified by methods known in the art, including, but not limited to, intravascular ultrasound and computed tomography (Sahara et al., European Heart Journal, Vol. 25: 2026-2033, 2004; Budhoff, J. Am. Coll. Cardiol., Vol. 48: 319-321, 2006; Hausleiter et al., J. Am. Coll. Cardiol., Vol. 48: 312-318, 2006).

In some embodiments of the methods of the invention, the RNAi construct is administered in combination with another therapeutic agent, such as a therapeutic agent for treating or preventing cardiovascular disease. In one embodiment, an RNAi construct of the invention is administered alone or in combination with other agents useful for treating the condition with which the patient is afflicted. Examples of such agents include both proteinaceous and non-proteinaceous drugs. When multiple therapeutics are co-administered, dosages may be adjusted accordingly, as is recognized in the pertinent art. "Co-administration" and combination therapy are not limited to simultaneous administration, but also include treatment regimens in which an RNAi construct of the invention is administered at least once during a course of treatment that involves administering at least one other therapeutic agent to the patient. In certain embodiments, an RNAi construct of the invention is administered prior to the administration of at least one other therapeutic agent. In other embodiments, an RNAi construct of the invention is administered concurrent with the administration of at least one other therapeutic agent. In some embodiments, an RNAi construct of the invention is administered subsequent to the administration of at least one other therapeutic agent.

In certain embodiments of the methods of the invention, the RNAi construct is administered to a patient in combination with a PCSK9 antagonist, such as an anti-hPCSK9 antibody (e.g., Repatha® (evolocumab)). In another embodiment, the RNAi construct of the invention is administered to a patient in combination with at least one other cholesterol-lowering (serum and/or total body cholesterol) agent. In some embodiments, the agent increases the expression of LDLR, has been observed to increase serum HDL levels, lower LDL levels, or lower triglyceride levels. Exemplary agents include, but are not limited to, statins (e.g., atorvastatin, cerivastatin, fluvastatin, lovastatin, mevastatin, pitavastatin, pravastatin, rosuvastatin, simvastatin); nicotinic acid (Niacin) (NIACOR, NIASPAN (slow release niacin), SLO-NIACIN (slow release niacin)); fibric acid (LOPID (Gemfibrozil), TRICOR (fenofibrate)); bile acid sequestrants (QUESTRAN (cholestyramine), colesevelam (WELCHOL), COLESTID (colestipol)); cholesterol absorption inhibitors (ZETIA (ezetimibe)), combining nicotinic acid with statin (ADVICOR (LOVASTATIN and NIASPAN), combinations of a statin with an absorption inhibitor (VYTORIN (ZOCOR and ZETIA); and/or lipid modifying agents.

In some embodiments, the RNAi construct of the invention is combined with PPAR gamma agonists, PPAR alpha/gamma agonists, squalene synthase inhibitors, CETP inhibitors, anti-hypertensives, anti-diabetic agents (such as sulphonyl ureas, insulin, GLP-1 analogs, DDPIV inhibitors), ApoB modulators, MTP inhibitors and/or arteriosclerosis obliterans treatments. In certain embodiments, the RNAi construct of the invention is combined with an agent that increases the level of LDL receptor (LDLR) protein in a patient, such as statins, certain cytokines, like oncostatin M, estrogen, and/or certain herbal ingredients, such as berberine.

In some embodiments, the RNAi construct of the invention is combined with an agent that increases serum cholesterol levels in a patient (such as certain anti-psycotic agents, certain HIV protease inhibitors, dietary factors such as high fructose, sucrose, cholesterol or certain fatty acids and certain nuclear receptor agonists and antagonists for RXR, RAR, LXR, FXR). In certain embodiments, the RNAi construct of the invention is combined with an agent that increases the level of PCSK9 protein in a subject, such as statins and/or insulin. The administration of RNAi constructs in such embodiments can allow for the RNAi construct to mitigate the undesirable side-effects of these other agents, such as increases in serum non-HDL cholesterol.

It is understood that all ribonucleic acid sequences disclosed herein can be converted to deoxyribonucleic acid sequences by substituting a thymine base for a uracil base in the sequence. Likewise, all deoxyribonucleic acid sequences disclosed herein can be converted to ribonucleic acid sequences by substituting a uracil base for a thymine base in the sequence. Deoxyribonucleic acid sequences, ribonucleic acid sequences, and sequences containing mixtures of deoxyribonucleotides and ribonucleotides of all sequences disclosed herein are included in the invention.

Additionally, any nucleic acid sequences disclosed herein may be modified with any combination of chemical modifications. One of skill in the art will readily appreciate that such designation as "RNA" or "DNA" to describe modified polynucleotides is, in certain instances, arbitrary. For example, a polynucleotide comprising a nucleotide having a 2'-OH substituent on the ribose sugar and a thymine base could be described as a DNA molecule having a modified sugar (2'-OH for the natural 2'-H of DNA) or as an RNA molecule having a modified base (thymine (methylated uracil) for natural uracil of RNA).

Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of a further example and without limitation, a polynucleotide having the sequence "ATCGATCG" encompasses any polynucleotides having such a sequence, whether modified or unmodified, including, but not limited to, such compounds comprising RNA bases, such as those having sequence "AUCGAUCG" and those having some DNA bases and some RNA bases such as "AUCGATCG" and polynucleotides having other modified bases, such as "ATmeCGAUCG," wherein meC indicates a cytosine base comprising a methyl group at the 5-position.

The following examples, including the experiments conducted and the results achieved, are provided for illustrative purposes only and are not to be construed as limiting the scope of the appended claims.

EXAMPLES

Example 1

Selection and Design of ASGR1 siRNA Sequences

The identification and selection of optimal sequences for therapeutic siRNA molecules targeting the human asialoglycoprotein receptor 1 (ASGR1) proceeded in two phases. Candidate sequences for inclusion in an initial Tier 1 screening set were identified using a bioinformatics analysis of two alternatively spliced transcripts for human ASGR1: transcript variant 1 encoding the longer isoform A (NCBI Reference Sequence No. NM_001671.4; see FIG. 1A) and transcript variant 2 encoding the shorter isoform B (NCBI Reference Sequence No. NM_001197216.2; see FIG. 1B). The two human ASGR1 transcript sequences were analyzed using an in-house siRNA design algorithm, which identifies 19mer sequences having a particular base content at certain positions or regions within the 19mer sequences. Sequences were also evaluated for identity to ASGR1 sequences in the mouse (NCBI Reference No. NM_009714.2; see FIG. 2), rat (FIG. 3), and cynomolgus monkey (NCBI Reference No. XM_005582698.1; see FIG. 4). 19mer sequences were also evaluated for sequence identity to other human gene sequences to predict off-target effects and for overlap with known single nucleotide polymorphisms. Based on the results of the bioinformatics analysis, 211 sequences were included in the Tier 1 screening set. A UU dinucleotide was added to the 3' end of the selected 19mer sense and antisense sequences to produce siRNA molecules with 19 base pair duplex regions and a 2 nucleotide overhang at the 3' ends of both strands.

The second phase of siRNA sequence selection was directed to identifying additional active siRNAs targeting the human ASGR1 mRNA that may have been excluded as a result of the bioinformatics analysis. All overlapping 19mer sequences from the human ASGR1 transcript variants 1 and 2 (NCBI Reference Sequence Nos. NM_001671.4 and NM_001197216.2; see FIGS. 1A and 1B) were extracted and reverse complement antisense sequences designed. 1284 sequences that were not included in Tier 1 were included as part of the Tier 2 sequences. Like the Tier 1 sequences, the Tier 2 sequences were converted to 21mers by adding a UU dinucleotide to the 3' ends of the sense and antisense strand to produce siRNA molecules with 19 base pair duplex regions and 2 nucleotide overhangs at each 3' end. Tier 2 also included 55 sequences identified in Tier 1 for resynthesis and testing. The combined Tier 1 and Tier 2 screening sets included 1495 19mer sequences across the human ASGR1 mRNA transcripts. The sense and antisense sequences of the siRNA molecules included in both Tier 1 and Tier 2 screening sets, as well as the sequences for 8 additional siRNA molecules that target the terminal regions of the transcripts, are shown in Table 1 below. The site within each of the human ASGR1 transcripts that is targeted by each of the siRNA molecules is also listed in Table 1.

TABLE 1

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1000 | 1000-1018 | 883-901 | UGUCCAGCACCACAUAGGCUU | 5 | GCCUAUGUGGUGCUGGACAUU | 1508 |
| D-1001 | 1001-1019 | 884-902 | GUCCAGCACCACAUAGGCCUU | 6 | GGCCUAUGUGGUGCUGGACUU | 1509 |
| D-1002 | 100-118 | 100-118 | CACCCCCACACUCCCCUAAUU | 7 | UUAGGGGAGUGUGGGGGUGUU | 1510 |
| D-1003 | 1002-1020 | 885-903 | UCCAGCACCACAUAGGCCCUU | 8 | GGGCCUAUGUGGUGCUGGAUU | 1511 |
| D-1004 | 1003-1021 | 886-904 | CCAGCACCACAUAGGCCCUUU | 9 | AGGGCCUAUGUGGUGCUGGUU | 1512 |
| D-1005 | 1004-1022 | 887-905 | CAGCACCACAUAGGCCCUGUU | 10 | CAGGGCCUAUGUGGUGCUGUU | 1513 |
| D-1006 | 1005-1023 | 888-906 | AGCACCACAUAGGCCCUGUUU | 11 | ACAGGGCCUAUGUGGUGCUUU | 1514 |
| D-1007 | 1006-1024 | 889-907 | GCACCACAUAGGCCCUGUGUU | 12 | CACAGGGCCUAUGUGGUGCUU | 1515 |
| D-1008 | 1007-1025 | 890-908 | CACCACAUAGGCCCUGUGAUU | 13 | UCACAGGGCCUAUGUGGUGUU | 1516 |
| D-1009 | 1008-1026 | 891-909 | ACCACAUAGGCCCUGUGAAUU | 14 | UUCACAGGGCCUAUGUGGUUU | 1517 |
| D-1010 | 1009-1027 | 892-910 | CCACAUAGGCCCUGUGAACUU | 15 | GUUCACAGGGCCUAUGUGGUU | 1518 |
| D-1011 | 1010-1028 | 893-911 | CACAUAGGCCCUGUGAACAUU | 16 | UGUUCACAGGGCCUAUGUGUU | 1519 |
| D-1012 | 1011-1029 | 894-912 | ACAUAGGCCCUGUGAACACUU | 17 | GUGUUCACAGGGCCUAUGUUU | 1520 |
| D-1013 | 101-119 | 101-119 | ACCCCCACACUCCCCUAAGUU | 18 | CUUAGGGGAGUGUGGGGGUUU | 1521 |
| D-1014 | 1012-1030 | 895-913 | CAUAGGCCCUGUGAACACCUU | 19 | GGUGUUCACAGGGCCUAUGUU | 1522 |
| D-1015 | 1013-1031 | 896-914 | AUAGGCCCUGUGAACACCUUU | 20 | AGGUGUUCACAGGGCCUAUUU | 1523 |
| D-1016 | 1014-1032 | 897-915 | UAGGCCCUGUGAACACCUGUU | 21 | CAGGUGUUCACAGGGCCUAUU | 1524 |
| D-1017 | 1015-1033 | 898-916 | AGGCCCUGUGAACACCUGGUU | 22 | CCAGGUGUUCACAGGGCCUUU | 1525 |
| D-1018 | 1016-1034 | 899-917 | GGCCCUGUGAACACCUGGAUU | 23 | UCCAGGUGUUCACAGGGCCUU | 1526 |
| D-1019 | 1017-1035 | 900-918 | GCCCUGUGAACACCUGGAUUU | 24 | AUCCAGGUGUUCACAGGGCUU | 1527 |
| D-1020 | 1018-1036 | 901-919 | CCCUGUGAACACCUGGAUGUU | 25 | CAUCCAGGUGUUCACAGGGUU | 1528 |
| D-1021 | 1019-1037 | 902-920 | CCUGUGAACACCUGGAUGGUU | 26 | CCAUCCAGGUGUUCACAGGUU | 1529 |
| D-1022 | 1020-1038 | 903-921 | CUGUGAACACCUGGAUGGGUU | 27 | CCCAUCCAGGUGUUCACAGUU | 1530 |
| D-1023 | 1021-1039 | 904-922 | UGUGAACACCUGGAUGGGCUU | 28 | GCCCAUCCAGGUGUUCACAUU | 1531 |
| D-1024 | 102-120 | 102-120 | CCCCCACACUCCCCUAAGUUU | 29 | ACUUAGGGGAGUGUGGGGGUU | 1532 |
| D-1025 | 1022-1040 | 905-923 | GUGAACACCUGGAUGGGCCUU | 30 | GGCCCAUCCAGGUGUUCACUU | 1533 |
| D-1026 | 1023-1041 | 906-924 | UGAACACCUGGAUGGGCCUUU | 31 | AGGCCCAUCCAGGUGUUCAUU | 1534 |
| D-1027 | 1024-1042 | 907-925 | GAACACCUGGAUGGGCCUCUU | 32 | GAGGCCCAUCCAGGUGUUCUU | 1535 |
| D-1028 | 1025-1043 | 908-926 | AACACCUGGAUGGGCCUCCUU | 33 | GGAGGCCCAUCCAGGUGUUUU | 1536 |
| D-1029 | 1026-1044 | 909-927 | ACACCUGGAUGGGCCUCCAUU | 34 | UGGAGGCCCAUCCAGGUGUUU | 1537 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1030 | 1027-1045 | 910-928 | CACCUGGAUGGGCCUCCACUU | 35 | GUGGAGGCCCAUCCAGGUGUU | 1538 |
| D-1031 | 10-28 | 10-28 | UGCACGGAAGAGUGAGGUGUU | 36 | CACCUCACUCUUCCGUGCAUU | 1539 |
| D-1032 | 1028-1046 | 911-929 | ACCUGGAUGGGCCUCCACGUU | 37 | CGUGGAGGCCCAUCCAGGUUU | 1540 |
| D-1033 | 1029-1047 | 912-930 | CCUGGAUGGGCCUCCACGAUU | 38 | UCGUGGAGGCCCAUCCAGGUU | 1541 |
| D-1034 | 1030-1048 | 913-931 | CUGGAUGGGCCUCCACGACUU | 39 | GUCGUGGAGGCCCAUCCAGUU | 1542 |
| D-1035 | 1031-1049 | 914-932 | UGGAUGGGCCUCCACGACCUU | 40 | GGUCGUGGAGGCCCAUCCAUU | 1543 |
| D-1036 | 103-121 | 103-121 | CCCCACACUCCCCUAAGUUUU | 41 | AACUUAGGGGAGUGUGGGGUU | 1544 |
| D-1037 | 1032-1050 | 915-933 | GGAUGGGCCUCCACGACCAUU | 42 | UGGUCGUGGAGGCCCAUCCUU | 1545 |
| D-1038 | 1033-1051 | 916-934 | GAUGGGCCUCCACGACCAAUU | 43 | UUGGUCGUGGAGGCCCAUCUU | 1546 |
| D-1039 | 1034-1052 | 917-935 | AUGGGCCUCCACGACCAAAUU | 44 | UUUGGUCGUGGAGGCCCAUUU | 1547 |
| D-1040 | 1035-1053 | 918-936 | UGGGCCUCCACGACCAAAAUU | 45 | UUUUGGUCGUGGAGGCCCAUU | 1548 |
| D-1041 | 1036-1054 | 919-937 | GGGCCUCCACGACCAAAACUU | 46 | GUUUUGGUCGUGGAGGCCCUU | 1549 |
| D-1042 | 1037-1055 | 920-938 | GGCCUCCACGACCAAAACGUU | 47 | CGUUUUGGUCGUGGAGGCCUU | 1550 |
| D-1043 | 1038-1056 | 921-939 | GCCUCCACGACCAAAACGGUU | 48 | CCGUUUUGGUCGUGGAGGCUU | 1551 |
| D-1044 | 1039-1057 | 922-940 | CCUCCACGACCAAAACGGGUU | 49 | CCCGUUUUGGUCGUGGAGGUU | 1552 |
| D-1045 | 1040-1058 | 923-941 | CUCCACGACCAAAACGGGCUU | 50 | GCCCGUUUUGGUCGUGGAGUU | 1553 |
| D-1046 | 1041-1059 | 924-942 | UCCACGACCAAAACGGGCCUU | 51 | GGCCCGUUUUGGUCGUGGAUU | 1554 |
| D-1047 | 104-122 | 104-122 | CCCACACUCCCCUAAGUUCUU | 52 | GAACUUAGGGGAGUGUGGGUU | 1555 |
| D-1048 | 1042-1060 | 925-943 | CCACGACCAAAACGGGCCCUU | 53 | GGGCCCGUUUUGGUCGUGGUU | 1556 |
| D-1049 | 1043-1061 | 926-944 | CACGACCAAAACGGGCCCUUU | 54 | AGGGCCCGUUUUGGUCGUGUU | 1557 |
| D-1050 | 1044-1062 | 927-945 | ACGACCAAAACGGGCCCUGUU | 55 | CAGGGCCCGUUUUGGUCGUUU | 1558 |
| D-1051 | 1045-1063 | 928-946 | CGACCAAAACGGGCCCUGGUU | 56 | CCAGGGCCCGUUUUGGUCGUU | 1559 |
| D-1052 | 1046-1064 | 929-947 | GACCAAAACGGGCCCUGGAUU | 57 | UCCAGGGCCCGUUUUGGUCUU | 1560 |
| D-1053 | 1047-1065 | 930-948 | ACCAAAACGGGCCCUGGAAUU | 58 | UUCCAGGGCCCGUUUUGGUUU | 1561 |
| D-1054 | 1048-1066 | 931-949 | CCAAAACGGGCCCUGGAAGUU | 59 | CUUCCAGGGCCCGUUUUGGUU | 1562 |
| D-1055 | 1049-1067 | 932-950 | CAAAACGGGCCCUGGAAGUUU | 60 | ACUUCCAGGGCCCGUUUUGUU | 1563 |
| D-1056 | 1050-1068 | 933-951 | AAAACGGGCCCUGGAAGUGUU | 61 | CACUUCCAGGGCCCGUUUUUU | 1564 |
| D-1057 | 1051-1069 | 934-952 | AAACGGGCCCUGGAAGUGGUU | 62 | CCACUUCCAGGGCCCGUUUUU | 1565 |
| D-1058 | 105-123 | 105-123 | CCACACUCCCCUAAGUUCCUU | 63 | GGAACUUAGGGGAGUGUGGUU | 1566 |
| D-1059 | 1052-1070 | 935-953 | AACGGGCCCUGGAAGUGGGUU | 64 | CCCACUUCCAGGGCCCGUUUU | 1567 |
| D-1060 | 1053-1071 | 936-954 | ACGGGCCCUGGAAGUGGGUUU | 65 | ACCCACUUCCAGGGCCCGUUU | 1568 |
| D-1061 | 1054-1072 | 937-955 | CGGGCCCUGGAAGUGGGUGUU | 66 | CACCCACUUCCAGGGCCCGUU | 1569 |
| D-1062 | 1055-1073 | 938-956 | GGGCCCUGGAAGUGGGUGGUU | 67 | CCACCCACUUCCAGGGCCCUU | 1570 |
| D-1063 | 1056-1074 | 939-957 | GGCCCUGGAAGUGGGUGGAUU | 68 | UCCACCCACUUCCAGGGCCUU | 1571 |
| D-1064 | 1057-1075 | 940-958 | GCCCUGGAAGUGGGUGGACUU | 69 | GUCCACCCACUUCCAGGGCUU | 1572 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1065 | 1058-1076 | 941-959 | CCCUGGAAGUGGGUGGACGUU | 70 | CGUCCACCCACUUCCAGGGUU | 1573 |
| D-1066 | 1059-1077 | 942-960 | CCUGGAAGUGGGUGGACGGUU | 71 | CCGUCCACCCACUUCCAGGUU | 1574 |
| D-1067 | 1060-1078 | 943-961 | CUGGAAGUGGGUGGACGGGUU | 72 | CCCGUCCACCCACUUCCAGUU | 1575 |
| D-1068 | 1061-1079 | 944-962 | UGGAAGUGGGUGGACGGGAUU | 73 | UCCCGUCCACCCACUUCCAUU | 1576 |
| D-1069 | 106-124 | 106-124 | CACACUCCCCUAAGUUCCAUU | 74 | UGGAACUUAGGGGAGUGUGUU | 1577 |
| D-1070 | 1062-1080 | 945-963 | GGAAGUGGGUGGACGGGACUU | 75 | GUCCCGUCCACCCACUUCCUU | 1578 |
| D-1071 | 1063-1081 | 946-964 | GAAGUGGGUGGACGGGACGUU | 76 | CGUCCCGUCCACCCACUUCUU | 1579 |
| D-1072 | 1064-1082 | 947-965 | AAGUGGGUGGACGGGACGGUU | 77 | CCGUCCCGUCCACCCACUUUU | 1580 |
| D-1073 | 1065-1083 | 948-966 | AGUGGGUGGACGGGACGGAUU | 78 | UCCGUCCCGUCCACCCACUUU | 1581 |
| D-1074 | 1066-1084 | 949-967 | GUGGGUGGACGGGACGGACUU | 79 | GUCCGUCCCGUCCACCCACUU | 1582 |
| D-1075 | 1067-1085 | 950-968 | UGGGUGGACGGGACGGACUUU | 80 | AGUCCGUCCCGUCCACCCAUU | 1583 |
| D-1076 | 1068-1086 | 951-969 | GGGUGGACGGGACGGACUAUU | 81 | UAGUCCGUCCCGUCCACCCUU | 1584 |
| D-1077 | 1069-1087 | 952-970 | GGUGGACGGGACGGACUACUU | 82 | GUAGUCCGUCCCGUCCACCUU | 1585 |
| D-1078 | 1070-1088 | 953-971 | GUGGACGGGACGGACUACGUU | 83 | CGUAGUCCGUCCCGUCCACUU | 1586 |
| D-1079 | 1071-1089 | 954-972 | UGGACGGGACGGACUACGAUU | 84 | UCGUAGUCCGUCCCGUCCAUU | 1587 |
| D-1080 | 107-125 | 107-125 | ACACUCCCCUAAGUUCCAAUU | 85 | UUGGAACUUAGGGGAGUGUUU | 1588 |
| D-1081 | 1072-1090 | 955-973 | GGACGGGACGGACUACGAGUU | 86 | CUCGUAGUCCGUCCCGUCCUU | 1589 |
| D-1082 | 1073-1091 | 956-974 | GACGGGACGGACUACGAGAUU | 87 | UCUCGUAGUCCGUCCCGUCUU | 1590 |
| D-1083 | 1074-1092 | 957-975 | ACGGGACGGACUACGAGACUU | 88 | GUCUCGUAGUCCGUCCCGUUU | 1591 |
| D-1084 | 1075-1093 | 958-976 | CGGGACGGACUACGAGACGUU | 89 | CGUCUCGUAGUCCGUCCCGUU | 1592 |
| D-1085 | 1076-1094 | 959-977 | GGGACGGACUACGAGACGGUU | 90 | CCGUCUCGUAGUCCGUCCCUU | 1593 |
| D-1086 | 1077-1095 | 960-978 | GGACGGACUACGAGACGGGUU | 91 | CCCGUCUCGUAGUCCGUCCUU | 1594 |
| D-1087 | 1078-1096 | 961-979 | GACGGACUACGAGACGGGCUU | 92 | GCCCGUCUCGUAGUCCGUCUU | 1595 |
| D-1088 | 1079-1097 | 962-980 | ACGGACUACGAGACGGGCUUU | 93 | AGCCCGUCUCGUAGUCCGUUU | 1596 |
| D-1089 | 1080-1098 | 963-981 | CGGACUACGAGACGGGCUUUU | 94 | AAGCCCGUCUCGUAGUCCGUU | 1597 |
| D-1090 | 1081-1099 | 964-982 | GGACUACGAGACGGGCUUCUU | 95 | GAAGCCCGUCUCGUAGUCCUU | 1598 |
| D-1091 | 108-126 | 108-126 | CACUCCCCUAAGUUCCAAUUU | 96 | AUUGGAACUUAGGGGAGUGUU | 1599 |
| D-1092 | 1082-1100 | 965-983 | GACUACGAGACGGGCUUCAUU | 97 | UGAAGCCCGUCUCGUAGUCUU | 1600 |
| D-1093 | 1083-1101 | 966-984 | ACUACGAGACGGGCUUCAAUU | 98 | UUGAAGCCCGUCUCGUAGUUU | 1601 |
| D-1094 | 1084-1102 | 967-985 | CUACGAGACGGGCUUCAAGUU | 99 | CUUGAAGCCCGUCUCGUAGUU | 1602 |
| D-1095 | 1085-1103 | 968-986 | UACGAGACGGGCUUCAAGAUU | 100 | UCUUGAAGCCCGUCUCGUAUU | 1603 |
| D-1096 | 1086-1104 | 969-987 | ACGAGACGGGCUUCAAGAAUU | 101 | UUCUUGAAGCCCGUCUCGUUU | 1604 |
| D-1097 | 1087-1105 | 970-988 | CGAGACGGGCUUCAAGAACUU | 102 | GUUCUUGAAGCCCGUCUCGUU | 1605 |
| D-1098 | 1088-1106 | 971-989 | GAGACGGGCUUCAAGAACUUU | 103 | AGUUCUUGAAGCCCGUCUCUU | 1606 |
| D-1099 | 1089-1107 | 972-990 | AGACGGGCUUCAAGAACUGUU | 104 | CAGUUCUUGAAGCCCGUCUUU | 1607 |
| D-1100 | 1090-1108 | 973-991 | GACGGGCUUCAAGAACUGGUU | 105 | CCAGUUCUUGAAGCCCGUCUU | 1608 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1101 | 1091-1109 | 974-992 | ACGGGCUUCAAGAACUGGAUU | 106 | UCCAGUUCUUGAAGCCCGUUU | 1609 |
| D-1102 | 109-127 | 109-127 | ACUCCCCUAAGUUCCAAUCUU | 107 | GAUUGGAACUUAGGGGAGUUU | 1610 |
| D-1103 | 1092-1110 | 975-993 | CGGGCUUCAAGAACUGGAGUU | 108 | CUCCAGUUCUUGAAGCCCGUU | 1611 |
| D-1104 | 1093-1111 | 976-994 | GGGCUUCAAGAACUGGAGGUU | 109 | CCUCCAGUUCUUGAAGCCCUU | 1612 |
| D-1105 | 1094-1112 | 977-995 | GGCUUCAAGAACUGGAGGCUU | 110 | GCCUCCAGUUCUUGAAGCCUU | 1613 |
| D-1106 | 1095-1113 | 978-996 | GCUUCAAGAACUGGAGGCCUU | 111 | GGCCUCCAGUUCUUGAAGCUU | 1614 |
| D-1107 | 1096-1114 | 979-997 | CUUCAAGAACUGGAGGCCGUU | 112 | CGGCCUCCAGUUCUUGAAGUU | 1615 |
| D-1108 | 1097-1115 | 980-998 | UUCAAGAACUGGAGGCCGGUU | 113 | CCGGCCUCCAGUUCUUGAAUU | 1616 |
| D-1109 | 1098-1116 | 981-999 | UCAAGAACUGGAGGCCGGAUU | 114 | UCCGGCCUCCAGUUCUUGAUU | 1617 |
| D-1110 | 1099-1117 | 982-1000 | CAAGAACUGGAGGCCGGAGUU | 115 | CUCCGGCCUCCAGUUCUUGUU | 1618 |
| D-1111 | 1100-1118 | 983-1001 | AAGAACUGGAGGCCGGAGCUU | 116 | GCUCCGGCCUCCAGUUCUUUU | 1619 |
| D-1112 | 1101-1119 | 984-1002 | AGAACUGGAGGCCGGAGCAUU | 117 | UGCUCCGGCCUCCAGUUCUUU | 1620 |
| D-1113 | 110-128 | 110-128 | CUCCCCUAAGUUCCAAUCCUU | 118 | GGAUUGGAACUUAGGGGAGUU | 1621 |
| D-1114 | 1102-1120 | 985-1003 | GAACUGGAGGCCGGAGCAGUU | 119 | CUGCUCCGGCCUCCAGUUCUU | 1622 |
| D-1115 | 1103-1121 | 986-1004 | AACUGGAGGCCGGAGCAGCUU | 120 | GCUGCUCCGGCCUCCAGUUUU | 1623 |
| D-1116 | 1104-1122 | 987-1005 | ACUGGAGGCCGGAGCAGCCUU | 121 | GGCUGCUCCGGCCUCCAGUUU | 1624 |
| D-1117 | 1105-1123 | 988-1006 | CUGGAGGCGGGAGCAGCCGUU | 122 | CGGCUGCUCCGGCCUCCAGUU | 1625 |
| D-1118 | 1106-1124 | 989-1007 | UGGAGGCCGGAGCAGCCGGUU | 123 | CCGGCUGCUCCGGCCUCCAUU | 1626 |
| D-1119 | 1107-1125 | 990-1008 | GGAGGCCGGAGCAGCCGGAUU | 124 | UCCGGCUGCUCCGGCCUCCUU | 1627 |
| D-1120 | 1108-1126 | 991-1009 | GAGGCCGGAGCAGCCGGACUU | 125 | GUCCGGCUGCUCCGGCCUCUU | 1628 |
| D-1121 | 1109-1127 | 992-1010 | AGGCCGGAGCAGCCGGACGUU | 126 | CGUCCGGCUGCUCCGGCCUUU | 1629 |
| D-1122 | 1110-1128 | 993-1011 | GGCCGGAGCAGCCGGACGAUU | 127 | UCGUCCGGCUGCUCCGGCCUU | 1630 |
| D-1123 | 1111-1129 | 994-1012 | GCCGGAGCAGCCGGACGACUU | 128 | GUCGUCCGGCUGCUCCGGCUU | 1631 |
| D-1124 | 111-129 | 111-129 | UCCCCUAAGUUCCAAUCCAUU | 129 | UGGAUUGGAACUUAGGGGAUU | 1632 |
| D-1125 | 1112-1130 | 995-1013 | CCGGAGCAGCCGGACGACUUU | 130 | AGUCGUCCGGCUGCUCCGGUU | 1633 |
| D-1126 | 1113-1131 | 996-1014 | CGGAGCAGCCGGACGACUGUU | 131 | CAGUCGUCCGGCUGCUCCGUU | 1634 |
| D-1127 | 1114-1132 | 997-1015 | GGAGCAGCCGGACGACUGGUU | 132 | CCAGUCGUCCGGCUGCUCCUU | 1635 |
| D-1128 | 1115-1133 | 998-1016 | GAGCAGCCGGACGACUGGUUU | 133 | ACCAGUCGUCCGGCUGCUCUU | 1636 |
| D-1129 | 1116-1134 | 999-1017 | AGCAGCCGGACGACUGGUAUU | 134 | UACCAGUCGUCCGGCUGCUUU | 1637 |
| D-1130 | 1117-1135 | 1000-1018 | GCAGCCGGACGACUGGUACUU | 135 | GUACCAGUCGUCCGGCUGCUU | 1638 |
| D-1131 | 1118-1136 | 1001-1019 | CAGCCGGACGACUGGUACGUU | 136 | CGUACCAGUCGUCCGGCUGUU | 1639 |
| D-1132 | 1119-1137 | 1002-1020 | AGCCGGACGACUGGUACGGUU | 137 | CCGUACCAGUCGUCCGGCUUU | 1640 |
| D-1133 | 1120-1138 | 1003-1021 | GCCGGACGACUGGUACGGCUU | 138 | GCCGUACCAGUCGUCCGGCUU | 1641 |
| D-1134 | 1121-1139 | 1004-1022 | CCGGACGACUGGUACGGCCUU | 139 | GGCCGUACCAGUCGUCCGGUU | 1642 |
| D-1135 | 112-130 | 112-130 | CCCCUAAGUUCCAAUCCAUUU | 140 | AUGGAUUGGAACUUAGGGGUU | 1643 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1136 | 1122-1140 | 1005-1023 | CGGACGACUGGUACGGCCAUU | 141 | UGGCCGUACCAGUCGUCCGUU | 1644 |
| D-1137 | 1123-1141 | 1006-1024 | GGACGACUGGUACGGCCACUU | 142 | GUGGCCGUACCAGUCGUCCUU | 1645 |
| D-1138 | 1124-1142 | 1007-1025 | GACGACUGGUACGGCCACGUU | 143 | CGUGGCCGUACCAGUCGUCUU | 1646 |
| D-1139 | 1125-1143 | 1008-1026 | ACGACUGGUACGGCCACGGUU | 144 | CCGUGGCCGUACCAGUCGUUU | 1647 |
| D-1140 | 1126-1144 | 1009-1027 | CGACUGGUACGGCCACGGGUU | 145 | CCCGUGGCCGUACCAGUCGUU | 1648 |
| D-1141 | 1127-1145 | 1010-1028 | GACUGGUACGGCCACGGGCUU | 146 | GCCCGUGGCCGUACCAGUCUU | 1649 |
| D-1142 | 1128-1146 | 1011-1029 | ACUGGUACGGCCACGGGCUUU | 147 | AGCCCGUGGCCGUACCAGUUU | 1650 |
| D-1143 | 11-29 | 11-29 | GCACGGAAGAGUGAGGUGAUU | 148 | UCACCUCACUCUUCCGUGCUU | 1651 |
| D-1144 | 1129-1147 | 1012-1030 | CUGGUACGGCCACGGGCUCUU | 149 | GAGCCCGUGGCCGUACCAGUU | 1652 |
| D-1145 | 1130-1148 | 1013-1031 | UGGUACGGCCACGGGCUCGUU | 150 | CGAGCCCGUGGCCGUACCAUU | 1653 |
| D-1146 | 1131-1149 | 1014-1032 | GGUACGGCCACGGGCUCGGUU | 151 | CCGAGCCCGUGGCCGUACCUU | 1654 |
| D-1147 | 113-131 | 113-131 | CCCUAAGUUCCAAUCCAUUUU | 152 | AAUGGAUUGGAACUUAGGGUU | 1655 |
| D-1148 | 1132-1150 | 1015-1033 | GUACGGCCACGGGCUCGGAUU | 153 | UCCGAGCCCGUGGCCGUACUU | 1656 |
| D-1149 | 1133-1151 | 1016-1034 | UACGGCCACGGGCUCGGAGUU | 154 | CUCCGAGCCCGUGGCCGUAUU | 1657 |
| D-1150 | 1134-1152 | 1017-1035 | ACGGCCACGGGCUCGGAGGUU | 155 | CCUCCGAGCCCGUGGCCGUUU | 1658 |
| D-1151 | 1135-1153 | 1018-1036 | CGGCCACGGGCUCGGAGGAUU | 156 | UCCUCCGAGCCCGUGGCCGUU | 1659 |
| D-1152 | 1136-1154 | 1019-1037 | GGCCACGGGCUCGGAGGAGUU | 157 | CUCCUCCGAGCCCGUGGCCUU | 1660 |
| D-1153 | 1137-1155 | 1020-1038 | GCCACGGGCUCGGAGGAGGUU | 158 | CCUCCUCCGAGCCCGUGGCUU | 1661 |
| D-1154 | 1138-1156 | 1021-1039 | CCACGGGCUCGGAGGAGGCUU | 159 | GCCUCCUCCGAGCCCGUGGUU | 1662 |
| D-1155 | 1139-1157 | 1022-1040 | CACGGGCUCGGAGGAGGCGUU | 160 | CGCCUCCUCCGAGCCCGUGUU | 1663 |
| D-1156 | 1140-1158 | 1023-1041 | ACGGGCUCGGAGGAGGCGAUU | 161 | UCGCCUCCUCCGAGCCCGUUU | 1664 |
| D-1157 | 1141-1159 | 1024-1042 | CGGGCUCGGAGGAGGCGAGUU | 162 | CUCGCCUCCUCCGAGCCCGUU | 1665 |
| D-1158 | 114-132 | 114-132 | CCUAAGUUCCAAUCCAUUUUU | 163 | AAAUGGAUUGGAACUUAGGUU | 1666 |
| D-1159 | 1142-1160 | 1025-1043 | GGGCUCGGAGGAGGCGAGGUU | 164 | CCUCGCCUCCUCCGAGCCCUU | 1667 |
| D-1160 | 1143-1161 | 1026-1044 | GGCUCGGAGGAGGCGAGGAUU | 165 | UCCUCGCCUCCUCCGAGCCUU | 1668 |
| D-1161 | 1144-1162 | 1027-1045 | GCUCGGAGGAGGCGAGGACUU | 166 | GUCCUCGCCUCCUCCGAGCUU | 1669 |
| D-1162 | 1145-1163 | 1028-1046 | CUCGGAGGAGGCGAGGACUUU | 167 | AGUCCUCGCCUCCUCCGAGUU | 1670 |
| D-1163 | 1146-1164 | 1029-1047 | UCGGAGGAGGCGAGGACUGUU | 168 | CAGUCCUCGCCUCCUCCGAUU | 1671 |
| D-1164 | 1147-1165 | 1030-1048 | CGGAGGAGGCGAGGACUGUUU | 169 | ACAGUCCUCGCCUCCUCCGUU | 1672 |
| D-1165 | 1148-1166 | 1031-1049 | GGAGGAGGCGAGGACUGUGUU | 170 | CACAGUCCUCGCCUCCUCCUU | 1673 |
| D-1166 | 1149-1167 | 1032-1050 | GAGGAGGCGAGGACUGUGCUU | 171 | GCACAGUCCUCGCCUCCUCUU | 1674 |
| D-1167 | 1150-1168 | 1033-1051 | AGGAGGCGAGGACUGUGCCUU | 172 | GGCACAGUCCUCGCCUCCUUU | 1675 |
| D-1168 | 1151-1169 | 1034-1052 | GGAGGCGAGGACUGUGCCCUU | 173 | GGGCACAGUCCUCGCCUCCUU | 1676 |
| D-1169 | 115-133 | 115-133 | CUAAGUUCCAAUCCAUUUCUU | 174 | GAAAUGGAUUGGAACUUAGUU | 1677 |
| D-1170 | 1152-1170 | 1035-1053 | GAGGCGAGGACUGUGCCCAUU | 175 | UGGGCACAGUCCUCGCCUCUU | 1678 |
| D-1171 | 1153-1171 | 1036-1054 | AGGCGAGGACUGUGCCCACUU | 176 | GUGGGCACAGUCCUCGCCUUU | 1679 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1172 | 1154-1172 | 1037-1055 | GGCGAGGACUGUGCCCACUUU | 177 | AGUGGGCACAGUCCUCGCCUU | 1680 |
| D-1173 | 1155-1173 | 1038-1056 | GCGAGGACUGUGCCCACUUUU | 178 | AAGUGGGCACAGUCCUCGCUU | 1681 |
| D-1174 | 1156-1174 | 1039-1057 | CGAGGACUGUGCCCACUUCUU | 179 | GAAGUGGGCACAGUCCUCGUU | 1682 |
| D-1175 | 1157-1175 | 1040-1058 | GAGGACUGUGCCCACUUCAUU | 180 | UGAAGUGGGCACAGUCCUCUU | 1683 |
| D-1176 | 1158-1176 | 1041-1059 | AGGACUGUGCCCACUUCACUU | 181 | GUGAAGUGGGCACAGUCCUUU | 1684 |
| D-1177 | 1159-1177 | 1042-1060 | GGACUGUGCCCACUUCACCUU | 182 | GGUGAAGUGGGCACAGUCCUU | 1685 |
| D-1178 | 1160-1178 | 1043-1061 | GACUGUGCCCACUUCACCGUU | 183 | CGGUGAAGUGGGCACAGUCUU | 1686 |
| D-1179 | 1161-1179 | 1044-1062 | ACUGUGCCCACUUCACCGAUU | 184 | UCGGUGAAGUGGGCACAGUUU | 1687 |
| D-1180 | 116-134 | 116-134 | UAAGUUCCAAUCCAUUUCCUU | 185 | GGAAAUGGAUUGGAACUUAUU | 1688 |
| D-1181 | 1162-1180 | 1045-1063 | CUGUGCCCACUUCACCGACUU | 186 | GUCGGUGAAGUGGGCACAGUU | 1689 |
| D-1182 | 1163-1181 | 1046-1064 | UGUGCCCACUUCACCGACGUU | 187 | CGUCGGUGAAGUGGGCACAUU | 1690 |
| D-1183 | 1164-1182 | 1047-1065 | GUGCCCACUUCACCGACGAUU | 188 | UCGUCGGUGAAGUGGGCACUU | 1691 |
| D-1184 | 1165-1183 | 1048-1066 | UGCCCACUUCACCGACGACUU | 189 | GUCGUCGGUGAAGUGGGCAUU | 1692 |
| D-1185 | 1166-1184 | 1049-1067 | GCCCACUUCACCGACGACGUU | 190 | CGUCGUCGGUGAAGUGGGCUU | 1693 |
| D-1186 | 1167-1185 | 1050-1068 | CCCACUUCACCGACGACGGUU | 191 | CCGUCGUCGGUGAAGUGGGUU | 1694 |
| D-1187 | 1168-1186 | 1051-1069 | CCACUUCACCGACGACGGCUU | 192 | GCCGUCGUCGGUGAAGUGGUU | 1695 |
| D-1188 | 1169-1187 | 1052-1070 | CACUUCACCGACGACGGCCUU | 193 | GGCCGUCGUCGGUGAAGUGUU | 1696 |
| D-1189 | 1170-1188 | 1053-1071 | ACUUCACCGACGACGGCCGUU | 194 | CGGCCGUCGUCGGUGAAGUUU | 1697 |
| D-1190 | 1171-1189 | 1054-1072 | CUUCACCGACGACGGCCGCUU | 195 | GCGGCCGUCGUCGGUGAAGUU | 1698 |
| D-1191 | 117-135 | 117-135 | AAGUUCCAAUCCAUUUCCAUU | 196 | UGGAAAUGGAUUGGAACUUUU | 1699 |
| D-1192 | 1172-1190 | 1055-1073 | UUCACCGACGACGGCCGCUUU | 197 | AGCGGCCGUCGUCGGUGAAUU | 1700 |
| D-1193 | 1173-1191 | 1056-1074 | UCACCGACGACGGCCGCUGUU | 198 | CAGCGGCCGUCGUCGGUGAUU | 1701 |
| D-1194 | 1174-1192 | 1057-1075 | CACCGACGACGGCCGCUGGUU | 199 | CCAGCGGCCGUCGUCGGUGUU | 1702 |
| D-1195 | 1175-1193 | 1058-1076 | ACCGACGACGGCCGCUGGAUU | 200 | UCCAGCGGCCGUCGUCGGUUU | 1703 |
| D-1196 | 1176-1194 | 1059-1077 | CCGACGACGGCCGCUGGAAUU | 201 | UUCCAGCGGCCGUCGUCGGUU | 1704 |
| D-1197 | 1177-1195 | 1060-1078 | CGACGACGGCCGCUGGAACUU | 202 | GUUCCAGCGGCCGUCGUCGUU | 1705 |
| D-1198 | 1178-1196 | 1061-1079 | GACGACGGCCGCUGGAACGUU | 203 | CGUUCCAGCGGCCGUCGUCUU | 1706 |
| D-1199 | 1179-1197 | 1062-1080 | ACGACGGCCGCUGGAACGAUU | 204 | UCGUUCCAGCGGCCGUCGUUU | 1707 |
| D-1200 | 1180-1198 | 1063-1081 | CGACGGCCGCUGGAACGACUU | 205 | GUCGUUCCAGCGGCCGUCGUU | 1708 |
| D-1201 | 1181-1199 | 1064-1082 | GACGGCCGCUGGAACGACGUU | 206 | CGUCGUUCCAGCGGCCGUCUU | 1709 |
| D-1202 | 118-136 | 118-136 | AGUUCCAAUCCAUUUCCACUU | 207 | GUGGAAAUGGAUUGGAACUUU | 1710 |
| D-1203 | 1182-1200 | 1065-1083 | ACGGCCGCUGGAACGACGAUU | 208 | UCGUCGUUCCAGCGGCCGUUU | 1711 |
| D-1204 | 1183-1201 | 1066-1084 | CGGCCGCUGGAACGACGACUU | 209 | GUCGUCGUUCCAGCGGCCGUU | 1712 |
| D-1205 | 1184-1202 | 1067-1085 | GGCCGCUGGAACGACGACGUU | 210 | CGUCGUCGUUCCAGCGGCCUU | 1713 |
| D-1206 | 1185-1203 | 1068-1086 | GCCGCUGGAACGACGACGUUU | 211 | ACGUCGUCGUUCCAGCGGCUU | 1714 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1207 | 1186-1204 | 1069-1087 | CCGCUGGAACGACGACGUCUUU | 212 | GACGUCGUCGUUCCAGCGGUU | 1715 |
| D-1208 | 1187-1205 | 1070-1088 | CGCUGGAACGACGACGUCUUUU | 213 | AGACGUCGUCGUUCCAGCGUU | 1716 |
| D-1209 | 1188-1206 | 1071-1089 | GCUGGAACGACGACGUCUGUUU | 214 | CAGACGUCGUCGUUCCAGCUU | 1717 |
| D-1210 | 1189-1207 | 1072-1090 | CUGGAACGACGACGUCUGCUU | 215 | GCAGACGUCGUCGUUCCAGUU | 1718 |
| D-1211 | 1-19 | 1-19 | CCCAAACGGUGCACGGAAGUU | 216 | CUUCCGUGCACCGUUUGGGUU | 1719 |
| D-1212 | 1190-1208 | 1073-1091 | UGGAACGACGACGUCUGCCUU | 217 | GGCAGACGUCGUCGUUCCAUU | 1720 |
| D-1213 | 1191-1209 | 1074-1092 | GGAACGACGACGUCUGCCAUU | 218 | UGGCAGACGUCGUCGUUCCUU | 1721 |
| D-1214 | 119-137 | 119-137 | GUUCCAAUCCAUUUCCACCUU | 219 | GGUGGAAAUGGAUUGGAACUU | 1722 |
| D-1215 | 1192-1210 | 1075-1093 | GAACGACGACGUCUGCCAGUU | 220 | CUGGCAGACGUCGUCGUUCUU | 1723 |
| D-1216 | 1193-1211 | 1076-1094 | AACGACGACGUCUGCCAGAUU | 221 | UCUGGCAGACGUCGUCGUUUU | 1724 |
| D-1217 | 1194-1212 | 1077-1095 | ACGACGACGUCUGCCAGAGUU | 222 | CUCUGGCAGACGUCGUCGUUU | 1725 |
| D-1218 | 1195-1213 | 1078-1096 | CGACGACGUCUGCCAGAGGUU | 223 | CCUCUGGCAGACGUCGUCGUU | 1726 |
| D-1219 | 1196-1214 | 1079-1097 | GACGACGUCUGCCAGAGGCUU | 224 | GCCUCUGGCAGACGUCGUCUU | 1727 |
| D-1220 | 1197-1215 | 1080-1098 | ACGACGUCUGCCAGAGGCCUU | 225 | GGCCUCUGGCAGACGUCGUUU | 1728 |
| D-1221 | 1198-1216 | 1081-1099 | CGACGUCUGCCAGAGGCCCUU | 226 | GGGCCUCUGGCAGACGUCGUU | 1729 |
| D-1222 | 1199-1217 | 1082-1100 | GACGUCUGCCAGAGGCCCUUU | 227 | AGGGCCUCUGGCAGACGUCUU | 1730 |
| D-1223 | 1200-1218 | 1083-1101 | ACGUCUGCCAGAGGCCCUAUU | 228 | UAGGGCCUCUGGCAGACGUUU | 1731 |
| D-1224 | 1201-1219 | 1084-1102 | CGUCUGCCAGAGGCCCUACUU | 229 | GUAGGGCCUCUGGCAGACGUU | 1732 |
| D-1225 | 120-138 | 120-138 | UUCCAAUCCAUUUCCACCUUU | 230 | AGGUGGAAAUGGAUUGGAAUU | 1733 |
| D-1226 | 1202-1220 | 1085-1103 | GUCUGCCAGAGGCCCUACCUU | 231 | GGUAGGGCCUCUGGCAGACUU | 1734 |
| D-1227 | 1203-1221 | 1086-1104 | UCUGCCAGAGGCCCUACCGUU | 232 | CGGUAGGGCCUCUGGCAGAUU | 1735 |
| D-1228 | 1204-1222 | 1087-1105 | CUGCCAGAGGCCCUACCGCUU | 233 | GCGGUAGGGCCUCUGGCAGUU | 1736 |
| D-1229 | 1205-1223 | 1088-1106 | UGCCAGAGGCCCUACCGCUUU | 234 | AGCGGUAGGGCCUCUGGCAUU | 1737 |
| D-1230 | 1206-1224 | 1089-1107 | GCCAGAGGCCCUACCGCUGUU | 235 | CAGCGGUAGGGCCUCUGGCUU | 1738 |
| D-1231 | 1207-1225 | 1090-1108 | CCAGAGGCCCUACCGCUGGUU | 236 | CCAGCGGUAGGGCCUCUGGUU | 1739 |
| D-1232 | 1208-1226 | 1091-1109 | CAGAGGCCCUACCGCUGGGUU | 237 | CCCAGCGGUAGGGCCUCUGUU | 1740 |
| D-1233 | 1209-1227 | 1092-1110 | AGAGGCCCUACCGCUGGGUUU | 238 | ACCCAGCGGUAGGGCCUCUUU | 1741 |
| D-1234 | 1210-1228 | 1093-1111 | GAGGCCCUACCGCUGGGUCUU | 239 | GACCCAGCGGUAGGGCCUCUU | 1742 |
| D-1235 | 1211-1229 | 1094-1112 | AGGCCCUACCGCUGGGUCUUU | 240 | AGACCCAGCGGUAGGGCCUUU | 1743 |
| D-1236 | 121-139 | 121-139 | UCCAAUCCAUUUCCACCUCUU | 241 | GAGGUGGAAAUGGAUUGGAUU | 1744 |
| D-1237 | 1212-1230 | 1095-1113 | GGCCCUACCGCUGGGUCUGUU | 242 | CAGACCCAGCGGUAGGGCCUU | 1745 |
| D-1238 | 1213-1231 | 1096-1114 | GCCCUACCGCUGGGUCUGCUU | 243 | GCAGACCCAGCGGUAGGGCUU | 1746 |
| D-1239 | 1214-1232 | 1097-1115 | CCCUACCGCUGGGUCUGCGUU | 244 | CGCAGACCCAGCGGUAGGGUU | 1747 |
| D-1240 | 1215-1233 | 1098-1116 | CCUACCGCUGGGUCUGCGAUU | 245 | UCGCAGACCCAGCGGUAGGUU | 1748 |
| D-1241 | 1216-1234 | 1099-1117 | CUACCGCUGGGUCUGCGAGUU | 246 | CUCGCAGACCCAGCGGUAGUU | 1749 |
| D-1242 | 1217-1235 | 1100-1118 | UACCGCUGGGUCUGCGAGAUU | 247 | UCUCGCAGACCCAGCGGUAUU | 1750 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1243 | 1218-1236 | 1101-1119 | ACCGCUGGGUCUGCGAGACUU | 248 | GUCUCGCAGACCCAGCGGUUU | 1751 |
| D-1244 | 1219-1237 | 1102-1120 | CCGCUGGGUCUGCGAGACAUU | 249 | UGUCUCGCAGACCCAGCGGUU | 1752 |
| D-1245 | 1220-1238 | 1103-1121 | CGCUGGGUCUGCGAGACAGUU | 250 | CUGUCUCGCAGACCCAGCGUU | 1753 |
| D-1246 | 1221-1239 | 1104-1122 | GCUGGGUCUGCGAGACAGAUU | 251 | UCUGUCUCGCAGACCCAGCUU | 1754 |
| D-1247 | 122-140 | 122-140 | CCAAUCCAUUCCACCUCUUU | 252 | AGAGGUGGAAAUGGAUUGGUU | 1755 |
| D-1248 | 1222-1240 | 1105-1123 | CUGGGUCUGCGAGACAGAGUU | 253 | CUCUGUCUCGCAGACCCAGUU | 1756 |
| D-1249 | 1223-1241 | 1106-1124 | UGGGUCUGCGAGACAGAGCUU | 254 | GCUCUGUCUCGCAGACCCAUU | 1757 |
| D-1250 | 1224-1242 | 1107-1125 | GGGUCUGCGAGACAGAGCUUU | 255 | AGCUCUGUCUCGCAGACCCUU | 1758 |
| D-1251 | 1225-1243 | 1108-1126 | GGUCUGCGAGACAGAGCUGUU | 256 | CAGCUCUGUCUCGCAGACCUU | 1759 |
| D-1252 | 1226-1244 | 1109-1127 | GUCUGCGAGACAGAGCUGGUU | 257 | CCAGCUCUGUCUCGCAGACUU | 1760 |
| D-1253 | 1227-1245 | 1110-1128 | UCUGCGAGACAGAGCUGGAUU | 258 | UCCAGCUCUGUCUCGCAGAUU | 1761 |
| D-1254 | 1228-1246 | 1111-1129 | CUGCGAGACAGAGCUGGACUU | 259 | GUCCAGCUCUGUCUCGCAGUU | 1762 |
| D-1255 | 1229-1247 | 1112-1130 | UGCGAGACAGAGCUGGACAUU | 260 | UGUCCAGCUCUGUCUCGCAUU | 1763 |
| D-1256 | 12-30 | 12-30 | CACGGAAGAGUGAGGUGACUU | 261 | GUCACCUCACUCUUCCGUGUU | 1764 |
| D-1257 | 1230-1248 | 1113-1131 | GCGAGACAGAGCUGGACAAUU | 262 | UUGUCCAGCUCUGUCUCGCUU | 1765 |
| D-1258 | 1231-1249 | 1114-1132 | CGAGACAGAGCUGGACAAGUU | 263 | CUUGUCCAGCUCUGUCUCGUU | 1766 |
| D-1259 | 123-141 | 123-141 | CAAUCCAUUUCCACCUCUGUU | 264 | CAGAGGUGGAAAUGGAUUGUU | 1767 |
| D-1260 | 1232-1250 | 1115-1133 | GAGACAGAGCUGGACAAGGUU | 265 | CCUUGUCCAGCUCUGUCUCUU | 1768 |
| D-1261 | 1233-1251 | 1116-1134 | AGACAGAGCUGGACAAGGCUU | 266 | GCCUUGUCCAGCUCUGUCUUU | 1769 |
| D-1262 | 1234-1252 | 1117-1135 | GACAGAGCUGGACAAGGCCUU | 267 | GGCCUUGUCCAGCUCUGUCUU | 1770 |
| D-1263 | 1235-1253 | 1118-1136 | ACAGAGCUGGACAAGGCCAUU | 268 | UGGCCUUGUCCAGCUCUGUUU | 1771 |
| D-1264 | 1236-1254 | 1119-1137 | CAGAGCUGGACAAGGCCAGUU | 269 | CUGGCCUUGUCCAGCUCUGUU | 1772 |
| D-1265 | 1237-1255 | 1120-1138 | AGAGCUGGACAAGGCCAGCUU | 270 | GCUGGCCUUGUCCAGCUCUUU | 1773 |
| D-1266 | 1238-1256 | 1121-1139 | GAGCUGGACAAGGCCAGCCUU | 271 | GGCUGGCCUUGUCCAGCUCUU | 1774 |
| D-1267 | 1239-1257 | 1122-1140 | AGCUGGACAAGGCCAGCCAUU | 272 | UGGCUGGCCUUGUCCAGCUUU | 1775 |
| D-1268 | 1240-1258 | 1123-1141 | GCUGGACAAGGCCAGCCAGUU | 273 | CUGGCUGGCCUUGUCCAGCUU | 1776 |
| D-1269 | 1241-1259 | 1124-1142 | CUGGACAAGGCCAGCCAGGUU | 274 | CCUGGCUGGCCUUGUCCAGUU | 1777 |
| D-1270 | 124-142 | 124-142 | AAUCCAUUUCCACCUCUGUUU | 275 | ACAGAGGUGGAAAUGGAUUUU | 1778 |
| D-1271 | 1242-1260 | 1125-1143 | UGGACAAGGCCAGCCAGGAUU | 276 | UCCUGGCUGGCCUUGUCCAUU | 1779 |
| D-1272 | 1243-1261 | 1126-1144 | GGACAAGGCCAGCCAGGAGUU | 277 | CUCCUGGCUGGCCUUGUCCUU | 1780 |
| D-1273 | 1244-1262 | 1127-1145 | GACAAGGCCAGCCAGGAGCUU | 278 | GCUCCUGGCUGGCCUUGUCUU | 1781 |
| D-1274 | 1245-1263 | 1128-1146 | ACAAGGCCAGCCAGGAGCCUU | 279 | GGCUCCUGGCUGGCCUUGUUU | 1782 |
| D-1275 | 1246-1264 | 1129-1147 | CAAGGCCAGCCAGGAGCCAUU | 280 | UGGCUCCUGGCUGGCCUUGUU | 1783 |
| D-1276 | 1247-1265 | 1130-1148 | AAGGCCAGCCAGGAGCCACUU | 281 | GUGGCUCCUGGCUGGCCUUUU | 1784 |
| D-1277 | 1248-1266 | 1131-1149 | AGGCCAGCCAGGAGCCACCUU | 282 | GGUGGCUCCUGGCUGGCCUUU | 1785 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1278 | 1249-1267 | 1132-1150 | GGCCAGCCAGGAGCCACCUUU | 283 | AGGUGGCUCCUGGCUGGCCUU | 1786 |
| D-1279 | 1250-1268 | 1133-1151 | GCCAGCCAGGAGCCACCUCUU | 284 | GAGGUGGCUCCUGGCUGGCUU | 1787 |
| D-1280 | 1251-1269 | 1134-1152 | CCAGCCAGGAGCCACCUCUUU | 285 | AGAGGUGGCUCCUGGCUGGUU | 1788 |
| D-1281 | 125-143 | 125-143 | AUCCAUUCCACCUCUGUUUUU | 286 | AACAGAGGUGGAAAUGGAUUU | 1789 |
| D-1282 | 1252-1270 | 1135-1153 | CAGCCAGGAGCCACCUCUCUU | 287 | GAGAGGUGGCUCCUGGCUGUU | 1790 |
| D-1283 | 1253-1271 | 1136-1154 | AGCCAGGAGCCACCUCUCCUU | 288 | GGAGAGGUGGCUCCUGGCUUU | 1791 |
| D-1284 | 1254-1272 | 1137-1155 | GCCAGGAGCCACCUCUCCUUU | 289 | AGGAGAGGUGGCUCCUGGCUU | 1792 |
| D-1285 | 1255-1273 | 1138-1156 | CCAGGAGCCACCUCUCCUUUU | 290 | AAGGAGAGGUGGCUCCUGGUU | 1793 |
| D-1286 | 1256-1274 | 1139-1157 | CAGGAGCCACCUCUCCUUUUU | 291 | AAAGGAGAGGUGGCUCCUGUU | 1794 |
| D-1287 | 1257-1275 | 1140-1158 | AGGAGCCACCUCUCCUUUAUU | 292 | UAAAGGAGAGGUGGCUCCUUU | 1795 |
| D-1288 | 1258-1276 | 1141-1159 | GGAGCCACCUCUCCUUUAAUU | 293 | UUAAAGGAGAGGUGGCUCCUU | 1796 |
| D-1289 | 1259-1277 | 1142-1160 | GAGCCACCUCUCCUUUAAUUU | 294 | AUUAAAGGAGAGGUGGCUCUU | 1797 |
| D-1290 | 1260-1278 | 1143-1161 | AGCCACCUCUCCUUUAAUUUU | 295 | AAUUAAAGGAGAGGUGGCUUU | 1798 |
| D-1291 | 1261-1279 | 1144-1162 | GCCACCUCUCCUUUAAUUUUU | 296 | AAAUUAAAGGAGAGGUGGCUU | 1799 |
| D-1292 | 126-144 | 126-144 | UCCAUUCCACCUCUGUUUUUU | 297 | AAACAGAGGUGGAAAUGGAUU | 1800 |
| D-1293 | 1262-1280 | 1145-1163 | CCACCUCUCCUUUAAUUUAUU | 298 | UAAAUUAAAGGAGAGGUGGUU | 1801 |
| D-1294 | 1263-1281 | 1146-1164 | CACCUCUCCUUUAAUUUAUUU | 299 | AUAAAUUAAAGGAGAGGUGUU | 1802 |
| D-1295 | 1264-1282 | 1147-1165 | ACCUCUCCUUUAAUUUAUUUU | 300 | AAUAAAUUAAAGGAGAGGUUU | 1803 |
| D-1296 | 1265-1283 | 1148-1166 | CCUCUCCUUUAAUUUAUUUUU | 301 | AAAUAAAUUAAAGGAGAGGUU | 1804 |
| D-1297 | 1266-1284 | 1149-1167 | CUCUCCUUUAAUUUAUUUCUU | 302 | GAAAUAAAUUAAAGGAGAGUU | 1805 |
| D-1298 | 1267-1285 | 1150-1168 | UCUCCUUUAAUUUAUUUCUUU | 303 | AGAAAUAAAUUAAAGGAGAUU | 1806 |
| D-1299 | 1268-1286 | 1151-1169 | CUCCUUUAAUUUAUUUCUUUU | 304 | AAGAAAUAAAUUAAAGGAGUU | 1807 |
| D-1300 | 1269-1287 | 1152-1170 | UCCUUUAAUUUAUUUCUUCUU | 305 | GAAGAAAUAAAUUAAAGGAUU | 1808 |
| D-1301 | 1270-1288 | 1153-1171 | CCUUUAAUUUAUUUCUUCAUU | 306 | UGAAGAAAUAAAUUAAAGGUU | 1809 |
| D-1302 | 1271-1289 | 1154-1172 | CUUUAAUUUAUUUCUUCAAUU | 307 | UUGAAGAAAUAAAUUAAAGUU | 1810 |
| D-1303 | 127-145 | 127-145 | CCAUUCCACCUCUGUUUUAUU | 308 | UAAACAGAGGUGGAAAUGGUU | 1811 |
| D-1304 | 1272-1290 | 1155-1173 | UUUAAUUUAUUUCUUCAAUUU | 309 | AUUGAAGAAAUAAAUUAAAUU | 1812 |
| D-1305 | 1273-1291 | 1156-1174 | UUAAUUUAUUUCUUCAAUGUU | 310 | CAUUGAAGAAAUAAAUUAAUU | 1813 |
| D-1306 | 1274-1292 | 1157-1175 | UAAUUUAUUUCUUCAAUGCUU | 311 | GCAUUGAAGAAAUAAAUUAUU | 1814 |
| D-1307 | 1275-1293 | 1158-1176 | AAUUUAUUUCUUCAAUGCCUU | 312 | GGCAUUGAAGAAAUAAAUUUU | 1815 |
| D-1308 | 1276-1294 | 1159-1177 | AUUUAUUUCUUCAAUGCCUUU | 313 | AGGCAUUGAAGAAAUAAAUUU | 1816 |
| D-1309 | 1277-1295 | 1160-1178 | UUUAUUUCUUCAAUGCCUCUU | 314 | GAGGCAUUGAAGAAAUAAAUU | 1817 |
| D-1310 | 1278-1296 | 1161-1179 | UUAUUUCUUCAAUGCCUCGUU | 315 | CGAGGCAUUGAAGAAAUAAUU | 1818 |
| D-1311 | 1279-1297 | 1162-1180 | UAUUUCUUCAAUGCCUCGAUU | 316 | UCGAGGCAUUGAAGAAAUAUU | 1819 |
| D-1312 | 1280-1298 | 1163-1181 | AUUUCUUCAAUGCCUCGACUU | 317 | GUCGAGGCAUUGAAGAAAUUU | 1820 |
| D-1313 | 1281-1299 | 1164-1182 | UUUCUUCAAUGCCUCGACCUU | 318 | GGUCGAGGCAUUGAAGAAAUU | 1821 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1314 | 128-146 | 128-146 | CAUUUCCACCUCUGUUUACUU | 319 | GUAAACAGAGGUGGAAAUGUU | 1822 |
| D-1315 | 1282-1300 | 1165-1183 | UUCUUCAAUGCCUCGACCUUU | 320 | AGGUCGAGGCAUUGAAGAAUU | 1823 |
| D-1316 | 1283-1301 | 1166-1184 | UCUUCAAUGCCUCGACCUGUU | 321 | CAGGUCGAGGCAUUGAAGAUU | 1824 |
| D-1317 | 1284-1302 | 1167-1185 | CUUCAAUGCCUCGACCUGCUU | 322 | GCAGGUCGAGGCAUUGAAGUU | 1825 |
| D-1318 | 1285-1303 | 1168-1186 | UUCAAUGCCUCGACCUGCCUU | 323 | GGCAGGUCGAGGCAUUGAAUU | 1826 |
| D-1319 | 1286-1304 | 1169-1187 | UCAAUGCCUCGACCUGCCGUU | 324 | CGGCAGGUCGAGGCAUUGAUU | 1827 |
| D-1320 | 1287-1305 | 1170-1188 | CAAUGCCUCGACCUGCCGCUU | 325 | GCGGCAGGUCGAGGCAUUGUU | 1828 |
| D-1321 | 1288-1306 | 1171-1189 | AAUGCCUCGACCUGCCGCAUU | 326 | UGCGGCAGGUCGAGGCAUUUU | 1829 |
| D-1322 | 1289-1307 | 1172-1190 | AUGCCUCGACCUGCCGCAGUU | 327 | CUGCGGCAGGUCGAGGCAUUU | 1830 |
| D-1323 | 1290-1308 | 1173-1191 | UGCCUCGACCUGCCGCAGGUU | 328 | CCUGCGGCAGGUCGAGGCAUU | 1831 |
| D-1324 | 1291-1309 | 1174-1192 | GCCUCGACCUGCCGCAGGGUU | 329 | CCCUGCGGCAGGUCGAGGCUU | 1832 |
| D-1325 | 129-147 | 129-147 | AUUUCCACCUCUGUUUACUUU | 330 | AGUAAACAGAGGUGGAAAUUU | 1833 |
| D-1326 | 1292-1310 | 1175-1193 | CCUCGACCUGCCGCAGGGGUU | 331 | CCCCUGCGGCAGGUCGAGGUU | 1834 |
| D-1327 | 1293-1311 | 1176-1194 | CUCGACCUGCCGCAGGGGUUU | 332 | ACCCCUGCGGCAGGUCGAGUU | 1835 |
| D-1328 | 1294-1312 | 1177-1195 | UCGACCUGCCGCAGGGGUCUU | 333 | GACCCCUGCGGCAGGUCGAUU | 1836 |
| D-1329 | 1295-1313 | 1178-1196 | CGACCUGCCGCAGGGGUCCUU | 334 | GGACCCCUGCGGCAGGUCGUU | 1837 |
| D-1330 | 1296-1314 | 1179-1197 | GACCUGCCGCAGGGGUCCGUU | 335 | CGGACCCCUGCGGCAGGUCUU | 1838 |
| D-1331 | 1297-1315 | 1180-1198 | ACCUGCCGCAGGGGUCCGGUU | 336 | CCGGACCCCUGCGGCAGGUUU | 1839 |
| D-1332 | 1298-1316 | 1181-1199 | CCUGCCGCAGGGGUCCGGGUU | 337 | CCCGGACCCCUGCGGCAGGUU | 1840 |
| D-1333 | 1299-1317 | 1182-1200 | CUGCCGCAGGGGUCCGGGAUU | 338 | UCCCGGACCCCUGCGGCAGUU | 1841 |
| D-1334 | 1300-1318 | 1183-1201 | UGCCGCAGGGGUCCGGGAUUU | 339 | AUCCCGGACCCCUGCGGCAUU | 1842 |
| D-1335 | 1301-1319 | 1184-1202 | GCCGCAGGGGUCCGGGAUUUU | 340 | AAUCCCGGACCCCUGCGGCUU | 1843 |
| D-1336 | 130-148 | 130-148 | UUUCCACCUCUGUUUACUGUU | 341 | CAGUAAACAGAGGUGGAAAUU | 1844 |
| D-1337 | 1302-1320 | 1185-1203 | CCGCAGGGGUCCGGGAUUGUU | 342 | CAAUCCCGGACCCCUGCGGUU | 1845 |
| D-1338 | 1303-1321 | 1186-1204 | CGCAGGGGUCCGGGAUUGGUU | 343 | CCAAUCCCGGACCCCUGCGUU | 1846 |
| D-1339 | 1304-1322 | 1187-1205 | GCAGGGGUCCGGGAUUGGGUU | 344 | CCCAAUCCCGGACCCCUGCUU | 1847 |
| D-1340 | 1305-1323 | 1188-1206 | CAGGGGUCCGGGAUUGGGAUU | 345 | UCCCAAUCCCGGACCCCUGUU | 1848 |
| D-1341 | 1306-1324 | 1189-1207 | AGGGGUCCGGGAUUGGGAAUU | 346 | UUCCCAAUCCCGGACCCCUUU | 1849 |
| D-1342 | 1307-1325 | 1190-1208 | GGGGUCCGGGAUUGGGAAUUU | 347 | AUUCCCAAUCCCGGACCCCUU | 1850 |
| D-1343 | 1308-1326 | 1191-1209 | GGGUCCGGGAUUGGGAAUCUU | 348 | GAUUCCCAAUCCCGGACCCUU | 1851 |
| D-1344 | 1309-1327 | 1192-1210 | GGUCCGGGAUUGGGAAUCCUU | 349 | GGAUUCCCAAUCCCGGACCUU | 1852 |
| D-1345 | 1310-1328 | 1193-1211 | GUCCGGGAUUGGGAAUCCGUU | 350 | CGGAUUCCCAAUCCCGGACUU | 1853 |
| D-1346 | 1311-1329 | 1194-1212 | UCCGGGAUUGGGAAUCCGCUU | 351 | GCGGAUUCCCAAUCCCGGAUU | 1854 |
| D-1347 | 131-149 | 131-149 | UUCCACCUCUGUUUACUGUUU | 352 | ACAGUAAACAGAGGUGGAAUU | 1855 |
| D-1348 | 1312-1330 | 1195-1213 | CCGGGAUUGGGAAUCCGCCUU | 353 | GGCGGAUUCCCAAUCCCGGUU | 1856 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1349 | 1313-1331 | 1196-1214 | CGGGAUUGGGAAUCCGCCCUU | 354 | GGGCGGAUUCCCAAUCCCGUU | 1857 |
| D-1350 | 1314-1332 | 1197-1215 | GGGAUUGGGAAUCCGCCCAUU | 355 | UGGGCGGAUUCCCAAUCCCUU | 1858 |
| D-1351 | 1315-1333 | 1198-1216 | GGAUUGGGAAUCCGCCCAUUU | 356 | AUGGGCGGAUUCCCAAUCCUU | 1859 |
| D-1352 | 1316-1334 | 1199-1217 | GAUUGGGAAUCCGCCCAUCUU | 357 | GAUGGGCGGAUUCCCAAUCUU | 1860 |
| D-1353 | 1317-1335 | 1200-1218 | AUUGGGAAUCCGCCCAUCUUU | 358 | AGAUGGGCGGAUUCCCAAUUU | 1861 |
| D-1354 | 1318-1336 | 1201-1219 | UUGGGAAUCCGCCCAUCUGUU | 359 | CAGAUGGGCGGAUUCCCAAUU | 1862 |
| D-1355 | 1319-1337 | 1202-1220 | UGGGAAUCCGCCCAUCUGGUU | 360 | CCAGAUGGGCGGAUUCCCAUU | 1863 |
| D-1356 | 1320-1338 | 1203-1221 | GGGAAUCCGCCCAUCUGGGUU | 361 | CCCAGAUGGGCGGAUUCCCUU | 1864 |
| D-1357 | 1321-1339 | 1204-1222 | GGAAUCCGCCCAUCUGGGGUU | 362 | CCCCAGAUGGGCGGAUUCCUU | 1865 |
| D-1358 | 132-150 | 132-150 | UCCACCUCUGUUUACUGUCUU | 363 | GACAGUAAACAGAGGUGGAUU | 1866 |
| D-1359 | 1322-1340 | 1205-1223 | GAAUCCGCCCAUCUGGGGGUU | 364 | CCCCCAGAUGGGCGGAUUCUU | 1867 |
| D-1360 | 1323-1341 | 1206-1224 | AAUCCGCCCAUCUGGGGGCUU | 365 | GCCCCCAGAUGGGCGGAUUUU | 1868 |
| D-1361 | 1324-1342 | 1207-1225 | AUCCGCCCAUCUGGGGGCCUU | 366 | GGCCCCCAGAUGGGCGGAUUU | 1869 |
| D-1362 | 1325-1343 | 1208-1226 | UCCGCCCAUCUGGGGGCCUUU | 367 | AGGCCCCCAGAUGGGCGGAUU | 1870 |
| D-1363 | 1326-1344 | 1209-1227 | CCGCCCAUCUGGGGGCCUCUU | 368 | GAGGCCCCCAGAUGGGCGGUU | 1871 |
| D-1364 | 1327-1345 | 1210-1228 | CGCCCAUCUGGGGGCCUCUUU | 369 | AGAGGCCCCCAGAUGGGCGUU | 1872 |
| D-1365 | 1328-1346 | 1211-1229 | GCCCAUCUGGGGGCCUCUUUU | 370 | AAGAGGCCCCCAGAUGGGCUU | 1873 |
| D-1366 | 1329-1347 | 1212-1230 | CCCAUCUGGGGGCCUCUUCUU | 371 | GAAGAGGCCCCCAGAUGGGUU | 1874 |
| D-1367 | 1330-1348 | 1213-1231 | CCAUCUGGGGGCCUCUUCUUU | 372 | AGAAGAGGCCCCCAGAUGGUU | 1875 |
| D-1368 | 13-31 | 13-31 | ACGGAAGAGUGAGGUGACUUU | 373 | AGUCACCUCACUCUUCCGUUU | 1876 |
| D-1369 | 1331-1349 | 1214-1232 | CAUCUGGGGGCCUCUUCUGUU | 374 | CAGAAGAGGCCCCCAGAUGUU | 1877 |
| D-1370 | 133-151 | 133-151 | CCACCUCUGUUUACUGUCCUU | 375 | GGACAGUAAACAGAGGUGGUU | 1878 |
| D-1371 | 1332-1350 | 1215-1233 | AUCUGGGGGCCUCUUCUGCUU | 376 | GCAGAAGAGGCCCCCAGAUUU | 1879 |
| D-1372 | 1333-1351 | 1216-1234 | UCUGGGGGCCUCUUCUGCUUU | 377 | AGCAGAAGAGGCCCCCAGAUU | 1880 |
| D-1373 | 1334-1352 | 1217-1235 | CUGGGGGCCUCUUCUGCUUUU | 378 | AAGCAGAAGAGGCCCCCAGUU | 1881 |
| D-1374 | 1335-1353 | 1218-1236 | UGGGGGCCUCUUCUGCUUUUU | 379 | AAAGCAGAAGAGGCCCCCAUU | 1882 |
| D-1375 | 1336-1354 | 1219-1237 | GGGGGCCUCUUCUGCUUUCUU | 380 | GAAAGCAGAAGAGGCCCCCUU | 1883 |
| D-1376 | 1337-1355 | 1220-1238 | GGGGCCUCUUCUGCUUUCUUU | 381 | AGAAAGCAGAAGAGGCCCCUU | 1884 |
| D-1377 | 1338-1356 | 1221-1239 | GGGCCUCUUCUGCUUUCUCUU | 382 | GAGAAAGCAGAAGAGGCCCUU | 1885 |
| D-1378 | 1339-1357 | 1222-1240 | GGCCUCUUCUGCUUUCUCGUU | 383 | CGAGAAAGCAGAAGAGGCCUU | 1886 |
| D-1379 | 1340-1358 | 1223-1241 | GCCUCUUCUGCUUUCUCGGUU | 384 | CCGAGAAAGCAGAAGAGGCUU | 1887 |
| D-1380 | 1341-1359 | 1224-1242 | CCUCUUCUGCUUUCUCGGGUU | 385 | CCCGAGAAAGCAGAAGAGGUU | 1888 |
| D-1381 | 134-152 | 134-152 | CACCUCUGUUUACUGUCCAUU | 386 | UGGACAGUAAACAGAGGUGUU | 1889 |
| D-1382 | 1342-1360 | 1225-1243 | CUCUUCUGCUUUCUCGGGAUU | 387 | UCCCGAGAAAGCAGAAGAGUU | 1890 |
| D-1383 | 1343-1361 | 1226-1244 | UCUUCUGCUUUCUCGGGAAUU | 388 | UUCCCGAGAAAGCAGAAGAUU | 1891 |
| D-1384 | 1344-1362 | 1227-1245 | CUUCUGCUUUCUCGGGAAUUU | 389 | AUUCCCGAGAAAGCAGAAGUU | 1892 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1385 | 1345-1363 | 1228-1246 | UUCUGCUUUCUCGGGAAUUUU | 390 | AAUUCCCGAGAAAGCAGAAUU | 1893 |
| D-1386 | 1346-1364 | 1229-1247 | UCUGCUUUCUCGGGAAUUUUU | 391 | AAAUUCCCGAGAAAGCAGAUU | 1894 |
| D-1387 | 1347-1365 | 1230-1248 | CUGCUUUCUCGGGAAUUUUUU | 392 | AAAAUUCCCGAGAAAGCAGUU | 1895 |
| D-1388 | 1348-1366 | 1231-1249 | UGCUUUCUCGGGAAUUUUCUU | 393 | GAAAAUUCCCGAGAAAGCAUU | 1896 |
| D-1389 | 1349-1367 | 1232-1250 | GCUUUCUCGGGAAUUUUCAUU | 394 | UGAAAAUUCCCGAGAAAGCUU | 1897 |
| D-1390 | 1350-1368 | 1233-1251 | CUUUCUCGGGAAUUUUCAUUU | 395 | AUGAAAAUUCCCGAGAAAGUU | 1898 |
| D-1391 | 1351-1369 | 1234-1252 | UUUCUCGGGAAUUUUCAUCUU | 396 | GAUGAAAAUUCCCGAGAAAUU | 1899 |
| D-1392 | 135-153 | 135-153 | ACCUCUGUUUACUGUCCAAUU | 397 | UUGGACAGUAAACAGAGGUUU | 1900 |
| D-1393 | 1352-1370 | 1235-1253 | UUCUCGGGAAUUUUCAUCUUU | 398 | AGAUGAAAAUUCCCGAGAAUU | 1901 |
| D-1394 | 1353-1371 | 1236-1254 | UCUCGGGAAUUUUCAUCUAUU | 399 | UAGAUGAAAAUUCCCGAGAUU | 1902 |
| D-1395 | 1354-1372 | 1237-1255 | CUCGGGAAUUUUCAUCUAGUU | 400 | CUAGAUGAAAAUUCCCGAGUU | 1903 |
| D-1396 | 1355-1373 | 1238-1256 | UCGGGAAUUUUCAUCUAGGUU | 401 | CCUAGAUGAAAAUUCCCGAUU | 1904 |
| D-1397 | 1356-1374 | 1239-1257 | CGGGAAUUUUCAUCUAGGAUU | 402 | UCCUAGAUGAAAAUUCCCGUU | 1905 |
| D-1398 | 1357-1375 | 1240-1258 | GGGAAUUUUCAUCUAGGAUUU | 403 | AUCCUAGAUGAAAAUUCCCUU | 1906 |
| D-1399 | 1358-1376 | 1241-1259 | GGAAUUUUCAUCUAGGAUUUU | 404 | AAUCCUAGAUGAAAAUUCCUU | 1907 |
| D-1400 | 1359-1377 | 1242-1260 | GAAUUUUCAUCUAGGAUUUUU | 405 | AAAUCCUAGAUGAAAAUUCUU | 1908 |
| D-1401 | 1360-1378 | 1243-1261 | AAUUUUCAUCUAGGAUUUUUU | 406 | AAAAUCCUAGAUGAAAAUUUU | 1909 |
| D-1402 | 1361-1379 | 1244-1262 | AUUUUCAUCUAGGAUUUUAUU | 407 | UAAAAUCCUAGAUGAAAAUUU | 1910 |
| D-1403 | 136-154 | 136-154 | CCUCUGUUUACUGUCCAAAUU | 408 | UUUGGACAGUAAACAGAGGUU | 1911 |
| D-1404 | 1362-1380 | 1245-1263 | UUUUCAUCUAGGAUUUUAAUU | 409 | UUAAAAUCCUAGAUGAAAAUU | 1912 |
| D-1405 | 1363-1381 | 1246-1264 | UUUCAUCUAGGAUUUUAAGUU | 410 | CUUAAAAUCCUAGAUGAAAUU | 1913 |
| D-1406 | 1364-1382 | 1247-1265 | UUCAUCUAGGAUUUUAAGGUU | 411 | CCUUAAAAUCCUAGAUGAAUU | 1914 |
| D-1407 | 1365-1383 | 1248-1266 | UCAUCUAGGAUUUUAAGGGUU | 412 | CCCUUAAAAUCCUAGAUGAUU | 1915 |
| D-1408 | 1366-1384 | 1249-1267 | CAUCUAGGAUUUUAAGGGAUU | 413 | UCCCUUAAAAUCCUAGAUGUU | 1916 |
| D-1409 | 1367-1385 | 1250-1268 | AUCUAGGAUUUUAAGGGAAUU | 414 | UUCCCUUAAAAUCCUAGAUUU | 1917 |
| D-1410 | 1368-1386 | 1251-1269 | UCUAGGAUUUUAAGGGAAGUU | 415 | CUUCCCUUAAAAUCCUAGAUU | 1918 |
| D-1411 | 1369-1387 | 1252-1270 | CUAGGAUUUUAAGGGAAGGUU | 416 | CCUUCCCUUAAAAUCCUAGUU | 1919 |
| D-1412 | 1370-1388 | 1253-1271 | UAGGAUUUUAAGGGAAGGGUU | 417 | CCCUUCCCUUAAAAUCCUAUU | 1920 |
| D-1413 | 1371-1389 | 1254-1272 | AGGAUUUUAAGGGAAGGGGUU | 418 | CCCCUUCCCUUAAAAUCCUUU | 1921 |
| D-1414 | 137-155 | 137-155 | CUCUGUUUACUGUCCAAAGUU | 419 | CUUGGACAGUAAACAGAGUU | 1922 |
| D-1415 | 1372-1390 | 1255-1273 | GGAUUUUAAGGGAAGGGGAUU | 420 | UCCCCUUCCCUUAAAAUCCUU | 1923 |
| D-1416 | 1373-1391 | 1256-1274 | GAUUUUAAGGGAAGGGGAAUU | 421 | UUCCCCUUCCCUUAAAAUCUU | 1924 |
| D-1417 | 1374-1392 | 1257-1275 | AUUUUAAGGGAAGGGGAAGUU | 422 | CUUCCCCUUCCCUUAAAAUUU | 1925 |
| D-1418 | 1375-1393 | 1258-1276 | UUUUAAGGGAAGGGGAAGGUU | 423 | CCUUCCCCUUCCCUUAAAAUU | 1926 |
| D-1419 | 1376-1394 | 1259-1277 | UUUAAGGGAAGGGGAAGGAUU | 424 | UCCUUCCCCUUCCCUUAAAUU | 1927 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1420 | 1377-1395 | 1260-1278 | UUAAGGGAAGGGGAAGGAUUU | 425 | AUCCUUCCCCUUCCCUUAAUU | 1928 |
| D-1421 | 1378-1396 | 1261-1279 | UAAGGGAAGGGGAAGGAUAUU | 426 | UAUCCUUCCCCUUCCCUUAUU | 1929 |
| D-1422 | 1379-1397 | 1262-1280 | AAGGGAAGGGGAAGGAUAGUU | 427 | CUAUCCUUCCCCUUCCCUUUU | 1930 |
| D-1423 | 1380-1398 | 1263-1281 | AGGGAAGGGGAAGGAUAGGUU | 428 | CCUAUCCUUCCCCUUCCCUUU | 1931 |
| D-1424 | 1381-1399 | 1264-1282 | GGGAAGGGGAAGGAUAGGGUU | 429 | CCCUAUCCUUCCCCUUCCCUU | 1932 |
| D-1425 | 138-156 | 138-156 | UCUGUUUACUGUCCAAAGUUU | 430 | ACUUUGGACAGUAAACAGAUU | 1933 |
| D-1426 | 1382-1400 | 1265-1283 | GGAAGGGGAAGGAUAGGGUUU | 431 | ACCCUAUCCUUCCCCUUCCUU | 1934 |
| D-1427 | 1383-1401 | 1266-1284 | GAAGGGGAAGGAUAGGGUGUU | 432 | CACCCUAUCCUUCCCCUUCUU | 1935 |
| D-1428 | 1384-1402 | 1267-1285 | AAGGGGAAGGAUAGGGUGAUU | 433 | UCACCCUAUCCUUCCCCUUUU | 1936 |
| D-1429 | 1385-1403 | 1268-1286 | AGGGGAAGGAUAGGGUGAUUU | 434 | AUCACCCUAUCCUUCCCCUUU | 1937 |
| D-1430 | 1386-1404 | 1269-1287 | GGGGAAGGAUAGGGUGAUGUU | 435 | CAUCACCCUAUCCUUCCCCUU | 1938 |
| D-1431 | 1387-1405 | 1270-1288 | GGGAAGGAUAGGGUGAUGUUU | 436 | ACAUCACCCUAUCCUUCCCUU | 1939 |
| D-1432 | 1388-1406 | 1271-1289 | GGAAGGAUAGGGUGAUGUUUU | 437 | AACAUCACCCUAUCCUUCCUU | 1940 |
| D-1433 | 1389-1407 | 1272-1290 | GAAGGAUAGGGUGAUGUUCUU | 438 | GAACAUCACCCUAUCCUUCUU | 1941 |
| D-1434 | 1390-1408 | 1273-1291 | AAGGAUAGGGUGAUGUUCCUU | 439 | GGAACAUCACCCUAUCCUUUU | 1942 |
| D-1435 | 1391-1409 | 1274-1292 | AGGAUAGGGUGAUGUUCCGUU | 440 | CGGAACAUCACCCUAUCCUUU | 1943 |
| D-1436 | 139-157 | 139-157 | CUGUUUACUGUCCAAAGUCUU | 441 | GACUUUGGACAGUAAACAGUU | 1944 |
| D-1437 | 1392-1410 | 1275-1293 | GGAUAGGGUGAUGUUCCGAUU | 442 | UCGGAACAUCACCCUAUCCUU | 1945 |
| D-1438 | 1393-1411 | 1276-1294 | GAUAGGGUGAUGUUCCGAAUU | 443 | UUCGGAACAUCACCCUAUCUU | 1946 |
| D-1439 | 1394-1412 | 1277-1295 | AUAGGGUGAUGUUCCGAAGUU | 444 | CUUCGGAACAUCACCCUAUUU | 1947 |
| D-1440 | 1395-1413 | 1278-1296 | UAGGGUGAUGUUCCGAAGGUU | 445 | CCUUCGGAACAUCACCCUAUU | 1948 |
| D-1441 | 1396-1414 | 1279-1297 | AGGGUGAUGUUCCGAAGGUUU | 446 | ACCUUCGGAACAUCACCCUUU | 1949 |
| D-1442 | 1397-1415 | 1280-1298 | GGGUGAUGUUCCGAAGGUGUU | 447 | CACCUUCGGAACAUCACCCUU | 1950 |
| D-1443 | 1398-1416 | 1281-1299 | GGUGAUGUUCCGAAGGUGAUU | 448 | UCACCUUCGGAACAUCACCUU | 1951 |
| D-1444 | 1399-1417 | 1282-1300 | GUGAUGUUCCGAAGGUGAGUU | 449 | CUCACCUUCGGAACAUCACUU | 1952 |
| D-1445 | 1400-1418 | 1283-1301 | UGAUGUUCCGAAGGUGAGGUU | 450 | CCUCACCUUCGGAACAUCAUU | 1953 |
| D-1446 | 1401-1419 | 1284-1302 | GAUGUUCCGAAGGUGAGGAUU | 451 | UCCUCACCUUCGGAACAUCUU | 1954 |
| D-1447 | 140-158 | 140-158 | UGUUUACUGUCCAAAGUCCUU | 452 | GGACUUUGGACAGUAAACAUU | 1955 |
| D-1448 | 1402-1420 | 1285-1303 | AUGUUCCGAAGGUGAGGAGUU | 453 | CUCCUCACCUUCGGAACAUUU | 1956 |
| D-1449 | 1403-1421 | 1286-1304 | UGUUCCGAAGGUGAGGAGCUU | 454 | GCUCCUCACCUUCGGAACAUU | 1957 |
| D-1450 | 1404-1422 | 1287-1305 | GUUCCGAAGGUGAGGAGCUUU | 455 | AGCUCCUCACCUUCGGAACUU | 1958 |
| D-1451 | 1405-1423 | 1288-1306 | UUCCGAAGGUGAGGAGCUUUU | 456 | AAGCUCCUCACCUUCGGAAUU | 1959 |
| D-1452 | 1406-1424 | 1289-1307 | UCCGAAGGUGAGGAGCUUGUU | 457 | CAAGCUCCUCACCUUCGGAUU | 1960 |
| D-1453 | 1407-1425 | 1290-1308 | CCGAAGGUGAGGAGCUUGAUU | 458 | UCAAGCUCCUCACCUUCGGUU | 1961 |
| D-1454 | 1408-1426 | 1291-1309 | CGAAGGUGAGGAGCUUGAAUU | 459 | UUCAAGCUCCUCACCUUCGUU | 1962 |
| D-1455 | 1409-1427 | 1292-1310 | GAAGGUGAGGAGCUUGAAAUU | 460 | UUUCAAGCUCCUCACCUUCUU | 1963 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1456 | 1410-1428 | 1293-1311 | AAGGUGAGGAGCUUGAAACUU | 461 | GUUUCAAGCUCCUCACCUUUU | 1964 |
| D-1457 | 1411-1429 | 1294-1312 | AGGUGAGGAGCUUGAAACCUU | 462 | GGUUUCAAGCUCCUCACCUUU | 1965 |
| D-1458 | 141-159 | 141-159 | GUUUACUGUCCAAAGUCCCUU | 463 | GGGACUUUGGACAGUAAACUU | 1966 |
| D-1459 | 1412-1430 | 1295-1313 | GGUGAGGAGCUUGAAACCCUU | 464 | GGGUUUCAAGCUCCUCACCUU | 1967 |
| D-1460 | 1413-1431 | 1296-1314 | GUGAGGAGCUUGAAACCCGUU | 465 | CGGGUUUCAAGCUCCUCACUU | 1968 |
| D-1461 | 1414-1432 | 1297-1315 | UGAGGAGCUUGAAACCCGUUU | 466 | ACGGGUUUCAAGCUCCUCAUU | 1969 |
| D-1462 | 1415-1433 | 1298-1316 | GAGGAGCUUGAAACCCGUGUU | 467 | CACGGGUUUCAAGCUCCUCUU | 1970 |
| D-1463 | 1416-1434 | 1299-1317 | AGGAGCUUGAAACCCGUGGUU | 468 | CCACGGGUUUCAAGCUCCUUU | 1971 |
| D-1464 | 1417-1435 | 1300-1318 | GGAGCUUGAAACCCGUGGCUU | 469 | GCCACGGGUUUCAAGCUCCUU | 1972 |
| D-1465 | 1418-1436 | 1301-1319 | GAGCUUGAAACCCGUGGCGUU | 470 | CGCCACGGGUUUCAAGCUCUU | 1973 |
| D-1466 | 1419-1437 | 1302-1320 | AGCUUGAAACCCGUGGCGCUU | 471 | GCGCCACGGGUUUCAAGCUUU | 1974 |
| D-1467 | 1420-1438 | 1303-1321 | GCUUGAAACCCGUGGCGCUUU | 472 | AGCGCCACGGGUUUCAAGCUU | 1975 |
| D-1468 | 1421-1439 | 1304-1322 | CUUGAAACCCGUGGCGCUUUU | 473 | AAGCGCCACGGGUUUCAAGUU | 1976 |
| D-1469 | 142-160 | 142-160 | UUUACUGUCCAAAGUCCCGUU | 474 | CGGGACUUUGGACAGUAAAUU | 1977 |
| D-1470 | 1422-1440 | 1305-1323 | UUGAAACCCGUGGCGCUUUUU | 475 | AAAGCGCCACGGGUUUCAAUU | 1978 |
| D-1471 | 1423-1441 | 1306-1324 | UGAAACCCGUGGCGCUUUCUU | 476 | GAAAGCGCCACGGGUUUCAUU | 1979 |
| D-1472 | 1424-1442 | 1307-1325 | GAAACCCGUGGCGCUUUCUUU | 477 | AGAAAGCGCCACGGGUUUCUU | 1980 |
| D-1473 | 1425-1443 | 1308-1326 | AAACCCGUGGCGCUUUCUGUU | 478 | CAGAAAGCGCCACGGGUUUUU | 1981 |
| D-1474 | 1426-1444 | 1309-1327 | AACCCGUGGCGCUUUCUGCUU | 479 | GCAGAAAGCGCCACGGGUUUU | 1982 |
| D-1475 | 1427-1445 | 1310-1328 | ACCCGUGGCGCUUUCUGCAUU | 480 | UGCAGAAAGCGCCACGGGUUU | 1983 |
| D-1476 | 1428-1446 | 1311-1329 | CCCGUGGCGCUUUCUGCAGUU | 481 | CUGCAGAAAGCGCCACGGGUU | 1984 |
| D-1477 | 1429-1447 | 1312-1330 | CCGUGGCGCUUUCUGCAGUUU | 482 | ACUGCAGAAAGCGCCACGGUU | 1985 |
| D-1478 | 1430-1448 | 1313-1331 | CGUGGCGCUUUCUGCAGUUUU | 483 | AACUGCAGAAAGCGCCACGUU | 1986 |
| D-1479 | 1431-1449 | 1314-1332 | GUGGCGCUUUCUGCAGUUUUU | 484 | AAACUGCAGAAAGCGCCACUU | 1987 |
| D-1480 | 143-161 | 143-161 | UUACUGUCCAAAGUCCCGGUU | 485 | CCGGGACUUUGGACAGUAAUU | 1988 |
| D-1481 | 14-32 | 14-32 | CGGAAGAGUGAGGUGACUGUU | 486 | CAGUCACCUCACUCUUCCGUU | 1989 |
| D-1482 | 1432-1450 | 1315-1333 | UGGCGCUUUCUGCAGUUUGUU | 487 | CAAACUGCAGAAAGCGCCAUU | 1990 |
| D-1483 | 1433-1451 | 1316-1334 | GGCGCUUUCUGCAGUUUGCUU | 488 | GCAAACUGCAGAAAGCGCCUU | 1991 |
| D-1484 | 1434-1452 | 1317-1335 | GCGCUUUCUGCAGUUUGCAUU | 489 | UGCAAACUGCAGAAAGCGCUU | 1992 |
| D-1485 | 1435-1453 | 1318-1336 | CGCUUUCUGCAGUUUGCAGUU | 490 | CUGCAAACUGCAGAAAGCGUU | 1993 |
| D-1486 | 1436-1454 | 1319-1337 | GCUUUCUGCAGUUUGCAGGUU | 491 | CCUGCAAACUGCAGAAAGCUU | 1994 |
| D-1487 | 1437-1455 | 1320-1338 | CUUUCUGCAGUUUGCAGGUUU | 492 | ACCUGCAAACUGCAGAAAGUU | 1995 |
| D-1488 | 1438-1456 | 1321-1339 | UUUCUGCAGUUUGCAGGUUUU | 493 | AACCUGCAAACUGCAGAAAUU | 1996 |
| D-1489 | 1439-1457 | 1322-1340 | UUCUGCAGUUUGCAGGUUAUU | 494 | UAACCUGCAAACUGCAGAAUU | 1997 |
| D-1490 | 1440-1458 | 1323-1341 | UCUGCAGUUUGCAGGUUAUUU | 495 | AUAACCUGCAAACUGCAGAUU | 1998 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1491 | 1441-1459 | 1324-1342 | CUGCAGUUUGCAGGUUAUCUU | 496 | GAUAACCUGCAAACUGCAGUU | 1999 |
| D-1492 | 144-162 | 144-162 | UACUGUCCAAAGUCCCGGGUU | 497 | CCCGGGACUUUGGACAGUAUU | 2000 |
| D-1493 | 1442-1460 | 1325-1343 | UGCAGUUUGCAGGUUAUCAUU | 498 | UGAUAACCUGCAAACUGCAUU | 2001 |
| D-1494 | 1443-1461 | 1326-1344 | GCAGUUUGCAGGUUAUCAUUU | 499 | AUGAUAACCUGCAAACUGCUU | 2002 |
| D-1495 | 1444-1462 | 1327-1345 | CAGUUUGCAGGUUAUCAUUUU | 500 | AAUGAUAACCUGCAAACUGUU | 2003 |
| D-1496 | 1445-1463 | 1328-1346 | AGUUUGCAGGUUAUCAUUGUU | 501 | CAAUGAUAACCUGCAAACUUU | 2004 |
| D-1497 | 1446-1464 | 1329-1347 | GUUUGCAGGUUAUCAUUGUUU | 502 | ACAAUGAUAACCUGCAAACUU | 2005 |
| D-1498 | 1447-1465 | 1330-1348 | UUUGCAGGUUAUCAUUGUGUU | 503 | CACAAUGAUAACCUGCAAAUU | 2006 |
| D-1499 | 1448-1466 | 1331-1349 | UUGCAGGUUAUCAUUGUGAUU | 504 | UCACAAUGAUAACCUGCAAUU | 2007 |
| D-1500 | 1449-1467 | 1332-1350 | UGCAGGUUAUCAUUGUGAAUU | 505 | UUCACAAUGAUAACCUGCAUU | 2008 |
| D-1501 | 1450-1468 | 1333-1351 | GCAGGUUAUCAUUGUGAACUU | 506 | GUUCACAAUGAUAACCUGCUU | 2009 |
| D-1502 | 1451-1469 | 1334-1352 | CAGGUUAUCAUUGUGAACUUU | 507 | AGUUCACAAUGAUAACCUGUU | 2010 |
| D-1503 | 145-163 | 145-163 | ACUGUCCAAAGUCCCGGGCUU | 508 | GCCCGGGACUUUGGACAGUUU | 2011 |
| D-1504 | 1452-1470 | 1335-1353 | AGGUUAUCAUUGUGAACUUUU | 509 | AAGUUCACAAUGAUAACCUUU | 2012 |
| D-1505 | 1453-1471 | 1336-1354 | GGUUAUCAUUGUGAACUUUUU | 510 | AAAGUUCACAAUGAUAACCUU | 2013 |
| D-1506 | 1454-1472 | 1337-1355 | GUUAUCAUUGUGAACUUUUUU | 511 | AAAAGUUCACAAUGAUAACUU | 2014 |
| D-1507 | 1455-1473 | 1338-1356 | UUAUCAUUGUGAACUUUUUUU | 512 | AAAAAGUUCACAAUGAUAAUU | 2015 |
| D-1508 | 1456-1474 | 1339-1357 | UAUCAUUGUGAACUUUUUUUU | 513 | AAAAAAGUUCACAAUGAUAUU | 2016 |
| D-1509 | 1457-1475 | 1340-1358 | AUCAUUGUGAACUUUUUUUUU | 514 | AAAAAAAGUUCACAAUGAUUU | 2017 |
| D-1510 | 1458-1476 | 1341-1359 | UCAUUGUGAACUUUUUUUUUU | 515 | AAAAAAAAGUUCACAAUGAUU | 2018 |
| D-1511 | 1459-1477 | 1342-1360 | CAUUGUGAACUUUUUUUUUUU | 516 | AAAAAAAAAGUUCACAAUGUU | 2019 |
| D-1512 | 1460-1478 | 1343-1361 | AUUGUGAACUUUUUUUUUUUU | 517 | AAAAAAAAAAGUUCACAAUUU | 2020 |
| D-1513 | 1461-1479 | 1344-1362 | UUGUGAACUUUUUUUUUUUUU | 518 | AAAAAAAAAAAGUUCACAAUU | 2021 |
| D-1514 | 146-164 | 146-164 | CUGUCCAAAGUCCCGGGCAUU | 519 | UGCCCGGGACUUUGGACAGUU | 2022 |
| D-1515 | 1462-1480 | 1345-1363 | UGUGAACUUUUUUUUUUUAUU | 520 | UAAAAAAAAAAGUUCACAUU | 2023 |
| D-1516 | 1463-1481 | 1346-1364 | GUGAACUUUUUUUUUUUAAUU | 521 | UUAAAAAAAAAAAGUUCACUU | 2024 |
| D-1517 | 1464-1482 | 1347-1365 | UGAACUUUUUUUUUUAAGUU | 522 | CUUAAAAAAAAAAAGUUCAUU | 2025 |
| D-1518 | 1465-1483 | 1348-1366 | GAACUUUUUUUUUUAAGAUU | 523 | UCUUAAAAAAAAAAAGUUCUU | 2026 |
| D-1519 | 1466-1484 | 1349-1367 | AACUUUUUUUUUUAAGAGUU | 524 | CUCUUAAAAAAAAAAAGUUUU | 2027 |
| D-1520 | 1467-1485 | 1350-1368 | ACUUUUUUUUUUAAGAGUUU | 525 | ACUCUUAAAAAAAAAAAGUUU | 2028 |
| D-1521 | 1468-1486 | 1351-1369 | CUUUUUUUUUUAAGAGUAUU | 526 | UACUCUUAAAAAAAAAAAGUU | 2029 |
| D-1522 | 1469-1487 | 1352-1370 | UUUUUUUUUUAAGAGUAAUU | 527 | UUACUCUUAAAAAAAAAAAUU | 2030 |
| D-1523 | 1470-1488 | 1353-1371 | UUUUUUUUUAAGAGUAAAUU | 528 | UUUACUCUUAAAAAAAAAAUU | 2031 |
| D-1524 | 1471-1489 | 1354-1372 | UUUUUUUUAAGAGUAAAAUU | 529 | UUUUACUCUUAAAAAAAAAUU | 2032 |
| D-1525 | 147-165 | 147-165 | UGUCCAAAGUCCCGGGCACUU | 530 | GUGCCCGGGACUUUGGACAUU | 2033 |
| D-1526 | 1472-1490 | 1355-1373 | UUUUUUUAAGAGUAAAAAUU | 531 | UUUUUACUCUUAAAAAAAAUU | 2034 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1527 | 1473-1491 | 1356-1374 | UUUUUUUAAGAGUAAAAAGUUU | 532 | CUUUUUACUCUUAAAAAAAUU | 2035 |
| D-1528 | 1474-1492 | 1357-1375 | UUUUUUAAGAGUAAAAAGAUU | 533 | UCUUUUUACUCUUAAAAAAUU | 2036 |
| D-1529 | 1475-1493 | 1358-1376 | UUUUUAAGAGUAAAAAGAAUU | 534 | UUCUUUUUACUCUUAAAAAUU | 2037 |
| D-1530 | 1476-1494 | 1359-1377 | UUUUAAGAGUAAAAAGAAAUU | 535 | UUUCUUUUUACUCUUAAAAUU | 2038 |
| D-1531 | 1477-1495 | 1360-1378 | UUUAAGAGUAAAAAGAAAUUU | 536 | AUUUCUUUUUACUCUUAAAUU | 2039 |
| D-1532 | 1478-1496 | 1361-1379 | UUAAGAGUAAAAAGAAAUAUU | 537 | UAUUUCUUUUUACUCUUAAUU | 2040 |
| D-1533 | 1479-1497 | 1362-1380 | UAAGAGUAAAAAGAAAUAUUU | 538 | AUAUUUCUUUUUACUCUUAUU | 2041 |
| D-1534 | 1480-1498 | 1363-1381 | AAGAGUAAAAAGAAAUAUAUU | 539 | UAUAUUUCUUUUUACUCUUUU | 2042 |
| D-1535 | 1481-1499 | 1364-1382 | AGAGUAAAAAGAAAUAUACUU | 540 | GUAUAUUUCUUUUUACUCUUU | 2043 |
| D-1536 | 148-166 | 148-166 | GUCCAAAGUCCCGGGCACUUU | 541 | AGUGCCCGGGACUUUGGACUU | 2044 |
| D-1537 | 1482-1500 | 1365-1383 | GAGUAAAAAGAAAUAUACCUU | 542 | GGUAUAUUUCUUUUUACUCUU | 2045 |
| D-1538 | 1483-1501 | — | AGUAAAAAGAAAUAUACCUUU | 543 | AGGUAUAUUUCUUUUUACUUU | 2046 |
| D-1539 | 1484-1502 | — | GUAAAAAGAAAUAUACCUAUU | 544 | UAGGUAUAUUUCUUUUUACUU | 2047 |
| D-1540 | 1485-1503 | — | UAAAAAGAAAUAUACCUAAUU | 545 | UUAGGUAUAUUUCUUUUUAUU | 2048 |
| D-1541 | 149-167 | 149-167 | UCCAAAGUCCCGGGCACUGUU | 546 | CAGUGCCCGGGACUUUGGAUU | 2049 |
| D-1542 | 150-168 | 150-168 | CCAAAGUCCCGGGCACUGGUU | 547 | CCAGUGCCCGGGACUUUGGUU | 2050 |
| D-1543 | 151-169 | 151-169 | CAAAGUCCCGGGCACUGGAUU | 548 | UCCAGUGCCCGGGACUUUGUU | 2051 |
| D-1544 | 152-170 | 152-170 | AAAGUCCCGGGCACUGGAGUU | 549 | CUCCAGUGCCCGGGACUUUUU | 2052 |
| D-1545 | 153-171 | 153-171 | AAGUCCCGGGCACUGGAGAUU | 550 | UCUCCAGUGCCCGGGACUUUU | 2053 |
| D-1546 | 15-33 | 15-33 | GGAAGAGUGAGGUGACUGGUU | 551 | CCAGUCACCUCACUCUUCCUU | 2054 |
| D-1547 | 154-172 | 154-172 | AGUCCCGGGCACUGGAGAUUU | 552 | AUCUCCAGUGCCCGGGACUUU | 2055 |
| D-1548 | 155-173 | 155-173 | GUCCCGGGCACUGGAGAUGUU | 553 | CAUCUCCAGUGCCCGGGACUU | 2056 |
| D-1549 | 156-174 | 156-174 | UCCCGGGCACUGGAGAUGCUU | 554 | GCAUCUCCAGUGCCCGGGAUU | 2057 |
| D-1550 | 157-175 | 157-175 | CCCGGGCACUGGAGAUGCCUU | 555 | GGCAUCUCCAGUGCCCGGGUU | 2058 |
| D-1551 | 158-176 | 158-176 | CCGGGCACUGGAGAUGCCAUU | 556 | UGGCAUCUCCAGUGCCCGGUU | 2059 |
| D-1552 | 159-177 | 159-177 | CGGGCACUGGAGAUGCCACUU | 557 | GUGGCAUCUCCAGUGCCCGUU | 2060 |
| D-1553 | 160-178 | 160-178 | GGGCACUGGAGAUGCCACGUU | 558 | CGUGGCAUCUCCAGUGCCCUU | 2061 |
| D-1554 | 161-179 | 161-179 | GGCACUGGAGAUGCCACGUUU | 559 | ACGUGGCAUCUCCAGUGCCUU | 2062 |
| D-1555 | 162-180 | 162-180 | GCACUGGAGAUGCCACGUUUU | 560 | AACGUGGCAUCUCCAGUGCUU | 2063 |
| D-1556 | 163-181 | 163-181 | CACUGGAGAUGCCACGUUUUU | 561 | AAACGUGGCAUCUCCAGUGUU | 2064 |
| D-1557 | 16-34 | 16-34 | GAAGAGUGAGGUGACUGGCUU | 562 | GCCAGUCACCUCACUCUUCUU | 2065 |
| D-1558 | 164-182 | 164-182 | ACUGGAGAUGCCACGUUUGUU | 563 | CAAACGUGGCAUCUCCAGUUU | 2066 |
| D-1559 | 165-183 | 165-183 | CUGGAGAUGCCACGUUUGGUU | 564 | CCAAACGUGGCAUCUCCAGUU | 2067 |
| D-1560 | 166-184 | 166-184 | UGGAGAUGCCACGUUUGGCUU | 565 | GCCAAACGUGGCAUCUCCAUU | 2068 |
| D-1561 | 167-185 | 167-185 | GGAGAUGCCACGUUUGGCGUU | 566 | CGCCAAACGUGGCAUCUCCUU | 2069 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1562 | 168-186 | 168-186 | GAGAUGCCACGUUUGGCGUUU | 567 | ACGCCAAACGUGGCAUCUCUU | 2070 |
| D-1563 | 169-187 | 169-187 | AGAUGCCACGUUUGGCGUGUU | 568 | CACGCCAAACGUGGCAUCUUU | 2071 |
| D-1564 | 170-188 | 170-188 | GAUGCCACGUUUGGCGUGCUU | 569 | GCACGCCAAACGUGGCAUCUU | 2072 |
| D-1565 | 171-189 | 171-189 | AUGCCACGUUUGGCGUGCUUU | 570 | AGCACGCCAAACGUGGCAUUU | 2073 |
| D-1566 | 172-190 | 172-190 | UGCCACGUUUGGCGUGCUUUU | 571 | AAGCACGCCAAACGUGGCAUU | 2074 |
| D-1567 | 173-191 | 173-191 | GCCACGUUUGGCGUGCUUGUU | 572 | CAAGCACGCCAAACGUGGCUU | 2075 |
| D-1568 | 17-35 | 17-35 | AAGAGUGAGGUGACUGGCAUU | 573 | UGCCAGUCACCUCACUCUUUU | 2076 |
| D-1569 | 174-192 | 174-192 | CCACGUUUGGCGUGCUUGGUU | 574 | CCAAGCACGCCAAACGUGGUU | 2077 |
| D-1570 | 175-193 | 175-193 | CACGUUUGGCGUGCUUGGAUU | 575 | UCCAAGCACGCCAAACGUGUU | 2078 |
| D-1571 | 176-194 | 176-194 | ACGUUUGGCGUGCUUGGACUU | 576 | GUCCAAGCACGCCAAACGUUU | 2079 |
| D-1572 | 177-195 | 177-195 | CGUUUGGCGUGCUUGGACAUU | 577 | UGUCCAAGCACGCCAAACGUU | 2080 |
| D-1573 | 178-196 | 178-196 | GUUUGGCGUGCUUGGACACUU | 578 | GUGUCCAAGCACGCCAAACUU | 2081 |
| D-1574 | 179-197 | 179-197 | UUUGGCGUGCUUGGACACAUU | 579 | UGUGUCCAAGCACGCCAAAUU | 2082 |
| D-1575 | 180-198 | 180-198 | UUGGCGUGCUUGGACACACUU | 580 | GUGUGUCCAAGCACGCCAAUU | 2083 |
| D-1576 | 181-199 | 181-199 | UGGCGUGCUUGGACACACAUU | 581 | UGUGUGUCCAAGCACGCCAUU | 2084 |
| D-1577 | 182-200 | 182-200 | GGCGUGCUUGGACACACAGUU | 582 | CUGUGUGUCCAAGCACGCCUU | 2085 |
| D-1578 | 183-201 | 183-201 | GCGUGCUUGGACACACAGAUU | 583 | UCUGUGUGUCCAAGCACGCUU | 2086 |
| D-1579 | 18-36 | 18-36 | AGAGUGAGGUGACUGGCAUUU | 584 | AUGCCAGUCACCUCACUCUUU | 2087 |
| D-1580 | 184-202 | 184-202 | CGUGCUUGGACACACAGACUU | 585 | GUCUGUGUGUCCAAGCACGUU | 2088 |
| D-1581 | 185-203 | 185-203 | GUGCUUGGACACACAGACAUU | 586 | UGUCUGUGUGUCCAAGCACUU | 2089 |
| D-1582 | 186-204 | 186-204 | UGCUUGGACACACAGACACUU | 587 | GUGUCUGUGUGUCCAAGCAUU | 2090 |
| D-1583 | 187-205 | 187-205 | GCUUGGACACACAGACACGUU | 588 | CGUGUCUGUGUGUCCAAGCUU | 2091 |
| D-1584 | 188-206 | 188-206 | CUUGGACACACAGACACGCUU | 589 | GCGUGUCUGUGUGUCCAAGUU | 2092 |
| D-1585 | 189-207 | 189-207 | UUGGACACACAGACACGCAUU | 590 | UGCGUGUCUGUGUGUCCAAUU | 2093 |
| D-1586 | 190-208 | 190-208 | UGGACACACAGACACGCAGUU | 591 | CUGCGUGUCUGUGUGUCCAUU | 2094 |
| D-1587 | 191-209 | 191-209 | GGACACACAGACACGCAGAUU | 592 | UCUGCGUGUCUGUGUGUCCUU | 2095 |
| D-1588 | 192-210 | 192-210 | GACACACAGACACGCAGACUU | 593 | GUCUGCGUGUCUGUGUGUCUU | 2096 |
| D-1589 | 193-211 | 193-211 | ACACACAGACACGCAGACAUU | 594 | UGUCUGCGUGUCUGUGUGUUU | 2097 |
| D-1590 | 19-37 | 19-37 | GAGUGAGGUGACUGGCAUGUU | 595 | CAUGCCAGUCACCUCACUCUU | 2098 |
| D-1591 | 194-212 | 194-212 | CACACAGACACGCAGACACUU | 596 | GUGUCUGCGUGUCUGUGUGUU | 2099 |
| D-1592 | 195-213 | 195-213 | ACACAGACACGCAGACACAUU | 597 | UGUGUCUGCGUGUCUGUGUUU | 2100 |
| D-1593 | 196-214 | 196-214 | CACAGACACGCAGACACAGUU | 598 | CUGUGUCUGCGUGUCUGUGUU | 2101 |
| D-1594 | 197-215 | 197-215 | ACAGACACGCAGACACAGAUU | 599 | UCUGUGUCUGCGUGUCUGUUU | 2102 |
| D-1595 | 198-216 | 198-216 | CAGACACGCAGACACAGAGUU | 600 | CUCUGUGUCUGCGUGUCUGUU | 2103 |
| D-1596 | 199-217 | 199-217 | AGACACGCAGACACAGAGAUU | 601 | UCUCUGUGUCUGCGUGUCUUU | 2104 |
| D-1597 | 200-218 | 200-218 | GACACGCAGACACAGAGACUU | 602 | GUCUCUGUGUCUGCGUGUCUU | 2105 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1598 | 201-219 | 201-219 | ACACGCAGACACAGAGACAUU | 603 | UGUCUCUGUGUCUGCGUGUUU | 2106 |
| D-1599 | 202-220 | 202-220 | CACGCAGACACAGAGACACUU | 604 | GUGUCUCUGUGUCUGCGUGUU | 2107 |
| D-1600 | 203-221 | 203-221 | ACGCAGACACAGAGACACCUU | 605 | GGUGUCUCUGUGUCUGCGUUU | 2108 |
| D-1601 | 20-38 | 20-38 | AGUGAGGUGACUGGCAUGUUU | 606 | ACAUGCCAGUCACCUCACUUU | 2109 |
| D-1602 | 204-222 | 204-222 | CGCAGACACAGAGACACCGUU | 607 | CGGUGUCUCUGUGUCUGCGUU | 2110 |
| D-1603 | 205-223 | 205-223 | GCAGACACAGAGACACCGGUU | 608 | CCGGUGUCUCUGUGUCUGCUU | 2111 |
| D-1604 | 206-224 | 206-224 | CAGACACAGAGACACCGGGUU | 609 | CCCGGUGUCUCUGUGUCUGUU | 2112 |
| D-1605 | 207-225 | 207-225 | AGACACAGAGACACCGGGGUU | 610 | CCCCGGUGUCUCUGUGUCUUU | 2113 |
| D-1606 | 208-226 | 208-226 | GACACAGAGACACCGGGGCUU | 611 | GCCCCGGUGUCUCUGUGUCUU | 2114 |
| D-1607 | 209-227 | 209-227 | ACACAGAGACACCGGGGCCUU | 612 | GGCCCCGGUGUCUCUGUGUUU | 2115 |
| D-1608 | 210-228 | 210-228 | CACAGAGACACCGGGGCCCUU | 613 | GGGCCCCGGUGUCUCUGUGUU | 2116 |
| D-1609 | 211-229 | 211-229 | ACAGAGACACCGGGGCCCAUU | 614 | UGGGCCCCGGUGUCUCUGUUU | 2117 |
| D-1610 | 212-230 | 212-230 | CAGAGACACCGGGGCCCAGUU | 615 | CUGGGCCCCGGUGUCUCUGUU | 2118 |
| D-1611 | 213-231 | 213-231 | AGAGACACCGGGGCCCAGGUU | 616 | CCUGGGCCCCGGUGUCUCUUU | 2119 |
| D-1612 | 21-39 | 21-39 | GUGAGGUGACUGGCAUGUGUU | 617 | CACAUGCCAGUCACCUCACUU | 2120 |
| D-1613 | 214-232 | 214-232 | GAGACACCGGGGCCCAGGGUU | 618 | CCCUGGGCCCCGGUGUCUCUU | 2121 |
| D-1614 | 215-233 | 215-233 | AGACACCGGGGCCCAGGGCUU | 619 | GCCCUGGGCCCCGGUGUCUUU | 2122 |
| D-1615 | 216-234 | 216-234 | GACACCGGGGCCCAGGGCCUU | 620 | GGCCCUGGGCCCCGGUGUCUU | 2123 |
| D-1616 | 217-235 | 217-235 | ACACCGGGGCCCAGGGCCCUU | 621 | GGGCCCUGGGCCCCGGUGUUU | 2124 |
| D-1617 | 218-236 | 218-236 | CACCGGGGCCCAGGGCCCUUU | 622 | AGGGCCCUGGGCCCCGGUGUU | 2125 |
| D-1618 | 219-237 | 219-237 | ACCGGGGCCCAGGGCCCUCUU | 623 | GAGGGCCCUGGGCCCCGGUUU | 2126 |
| D-1619 | 2-20 | 2-20 | CCAAACGGUGCACGGAAGAUU | 624 | UCUUCCGUGCACCGUUUGGUU | 2127 |
| D-1620 | 220-238 | 220-238 | CCGGGGCCCAGGGCCCUCCUU | 625 | GGAGGGCCCUGGGCCCCGGUU | 2128 |
| D-1621 | 221-239 | 221-239 | CGGGGCCCAGGGCCCUCCUUU | 626 | AGGAGGGCCCUGGGCCCCGUU | 2129 |
| D-1622 | 222-240 | 222-240 | GGGGCCCAGGGCCCUCCUAUU | 627 | UAGGAGGGCCCUGGGCCCCUU | 2130 |
| D-1623 | 223-241 | 223-241 | GGGCCCAGGGCCCUCCUAUUU | 628 | AUAGGAGGGCCCUGGGCCCUU | 2131 |
| D-1624 | 22-40 | 22-40 | UGAGGUGACUGGCAUGUGUUU | 629 | ACACAUGCCAGUCACCUCAUU | 2132 |
| D-1625 | 224-242 | 224-242 | GGCCCAGGGCCCUCCUAUGUU | 630 | CAUAGGAGGGCCCUGGGCCUU | 2133 |
| D-1626 | 225-243 | 225-243 | GCCCAGGGCCCUCCUAUGGUU | 631 | CCAUAGGAGGGCCCUGGGCUU | 2134 |
| D-1627 | 226-244 | 226-244 | CCCAGGGCCCUCCUAUGGAUU | 632 | UCCAUAGGAGGGCCCUGGGUU | 2135 |
| D-1628 | 227-245 | 227-245 | CCAGGGCCCUCCUAUGGACUU | 633 | GUCCAUAGGAGGGCCCUGGUU | 2136 |
| D-1629 | 228-246 | 228-246 | CAGGGCCCUCCUAUGGACCUU | 634 | GGUCCAUAGGAGGGCCCUGUU | 2137 |
| D-1630 | 229-247 | 229-247 | AGGGCCCUCCUAUGGACCCUU | 635 | GGGUCCAUAGGAGGGCCCUUU | 2138 |
| D-1631 | 230-248 | 230-248 | GGGCCCUCCUAUGGACCCUUU | 636 | AGGGUCCAUAGGAGGGCCCUU | 2139 |
| D-1632 | 231-249 | 231-249 | GGCCCUCCUAUGGACCCUGUU | 637 | CAGGGUCCAUAGGAGGGCCUU | 2140 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1633 | 232-250 | 232-250 | GCCCUCCUAUGGACCCUGCUU | 638 | GCAGGGUCCAUAGGAGGGCUU | 2141 |
| D-1634 | 233-251 | 233-251 | CCCUCCUAUGGACCCUGCCUU | 639 | GGCAGGGUCCAUAGGAGGGUU | 2142 |
| D-1635 | 23-41 | 23-41 | GAGGUGACUGGCAUGUGUGUU | 640 | CACACAUGCCAGUCACCUCUU | 2143 |
| D-1636 | 234-252 | 234-252 | CCUCCUAUGGACCCUGCCCUU | 641 | GGGCAGGGUCCAUAGGAGGUU | 2144 |
| D-1637 | 235-253 | 235-253 | CUCCUAUGGACCCUGCCCGUU | 642 | CGGGCAGGGUCCAUAGGAGUU | 2145 |
| D-1638 | 236-254 | 236-254 | UCCUAUGGACCCUGCCCGCUU | 643 | GCGGGCAGGGUCCAUAGGAUU | 2146 |
| D-1639 | 237-255 | 237-255 | CCUAUGGACCCUGCCCGCUUU | 644 | AGCGGGCAGGGUCCAUAGGUU | 2147 |
| D-1640 | 238-256 | 238-256 | CUAUGGACCCUGCCCGCUCUU | 645 | GAGCGGGCAGGGUCCAUAGUU | 2148 |
| D-1641 | 239-257 | 239-257 | UAUGGACCCUGCCCGCUCCUU | 646 | GGAGCGGGCAGGGUCCAUAUU | 2149 |
| D-1642 | 240-258 | 240-258 | AUGGACCCUGCCCGCUCCCUU | 647 | GGGAGCGGGCAGGGUCCAUUU | 2150 |
| D-1643 | 241-259 | 241-259 | UGGACCCUGCCCGCUCCCCUU | 648 | GGGGAGCGGGCAGGGUCCAUU | 2151 |
| D-1644 | 242-260 | 242-260 | GGACCCUGCCCGCUCCCCUUU | 649 | AGGGGAGCGGGCAGGGUCCUU | 2152 |
| D-1645 | 243-261 | 243-261 | GACCCUGCCCGCUCCCCUCUU | 650 | GAGGGGAGCGGGCAGGGUCUU | 2153 |
| D-1646 | 24-42 | 24-42 | AGGUGACUGGCAUGUGUGGUU | 651 | CCACACAUGCCAGUCACCUUU | 2154 |
| D-1647 | 244-262 | 244-262 | ACCCUGCCCGCUCCCCUCCUU | 652 | GGAGGGGAGCGGGCAGGGUUU | 2155 |
| D-1648 | 245-263 | 245-263 | CCCUGCCCGCUCCCCUCCCUU | 653 | GGGAGGGGAGCGGGCAGGGUU | 2156 |
| D-1649 | 246-264 | 246-264 | CCUGCCCGCUCCCCUCCCAUU | 654 | UGGGAGGGGAGCGGGCAGGUU | 2157 |
| D-1650 | 247-265 | 247-265 | CUGCCCGCUCCCCUCCCAUUU | 655 | AUGGGAGGGGAGCGGGCAGUU | 2158 |
| D-1651 | 248-266 | 248-266 | UGCCCGCUCCCCUCCCAUUUU | 656 | AAUGGGAGGGGAGCGGGCAUU | 2159 |
| D-1652 | 249-267 | 249-267 | GCCCGCUCCCCUCCCAUUGUU | 657 | CAAUGGGAGGGGAGCGGGCUU | 2160 |
| D-1653 | 250-268 | 250-268 | CCCGCUCCCCUCCCAUUGUUU | 658 | ACAAUGGGAGGGGAGCGGGUU | 2161 |
| D-1654 | 251-269 | 251-269 | CCGCUCCCCUCCCAUUGUCUU | 659 | GACAAUGGGAGGGGAGCGGUU | 2162 |
| D-1655 | 252-270 | 252-270 | CGCUCCCCUCCCAUUGUCCUU | 660 | GGACAAUGGGAGGGGAGCGUU | 2163 |
| D-1656 | 253-271 | 253-271 | GCUCCCCUCCCAUUGUCCAUU | 661 | UGGACAAUGGGAGGGGAGCUU | 2164 |
| D-1657 | 254-272 | 254-272 | CUCCCCUCCCAUUGUCCACUU | 662 | GUGGACAAUGGGAGGGGAGUU | 2165 |
| D-1658 | 25-43 | 25-43 | GGUGACUGGCAUGUGUGGGUU | 663 | CCCACACAUGCCAGUCACCUU | 2166 |
| D-1659 | 255-273 | 255-273 | UCCCCUCCCAUUGUCCACGUU | 664 | CGUGGACAAUGGGAGGGGAUU | 2167 |
| D-1660 | 256-274 | 256-274 | CCCCUCCCAUUGUCCACGGUU | 665 | CCGUGGACAAUGGGAGGGGUU | 2168 |
| D-1661 | 257-275 | 257-275 | CCCUCCCAUUGUCCACGGCUU | 666 | GCCGUGGACAAUGGGAGGGUU | 2169 |
| D-1662 | 258-276 | 258-276 | CCUCCCAUUGUCCACGGCUUU | 667 | AGCCGUGGACAAUGGGAGGUU | 2170 |
| D-1663 | 259-277 | 259-277 | CUCCCAUUGUCCACGGCUGUU | 668 | CAGCCGUGGACAAUGGGAGUU | 2171 |
| D-1664 | 260-278 | 260-278 | UCCCAUUGUCCACGGCUGUUU | 669 | ACAGCCGUGGACAAUGGGAUU | 2172 |
| D-1665 | 261-279 | 261-279 | CCCAUUGUCCACGGCUGUCUU | 670 | GACAGCCGUGGACAAUGGGUU | 2173 |
| D-1666 | 262-280 | 262-280 | CCAUUGUCCACGGCUGUCCUU | 671 | GGACAGCCGUGGACAAUGGUU | 2174 |
| D-1667 | 263-281 | 263-281 | CAUUGUCCACGGCUGUCCGUU | 672 | CGGACAGCCGUGGACAAUGUU | 2175 |
| D-1668 | 264-282 | 264-282 | AUUGUCCACGGCUGUCCGCUU | 673 | GCGGACAGCCGUGGACAAUUU | 2176 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1669 | 26-44 | 26-44 | GUGACUGGCAUGUGUGGGGUU | 674 | CCCCACACAUGCCAGUCACUU | 2177 |
| D-1670 | 265-283 | 265-283 | UUGUCCACGGCUGUCCGCCUU | 675 | GGCGGACAGCCGUGGACAAUU | 2178 |
| D-1671 | 266-284 | 266-284 | UGUCCACGGCUGUCCGCCCUU | 676 | GGGCGGACAGCCGUGGACAUU | 2179 |
| D-1672 | 267-285 | 267-285 | GUCCACGGCUGUCCGCCCAUU | 677 | UGGGCGGACAGCCGUGGACUU | 2180 |
| D-1673 | 268-286 | 268-286 | UCCACGGCUGUCCGCCCACUU | 678 | GUGGGCGGACAGCCGUGGAUU | 2181 |
| D-1674 | 269-287 | 269-287 | CCACGGCUGUCCGCCCACCUU | 679 | GGUGGGCGGACAGCCGUGGUU | 2182 |
| D-1675 | 270-288 | 270-288 | CACGGCUGUCCGCCCACCCUU | 680 | GGGUGGGCGGACAGCCGUGUU | 2183 |
| D-1676 | 271-289 | 271-289 | ACGGCUGUCCGCCCACCCCUU | 681 | GGGGUGGGCGGACAGCCGUUU | 2184 |
| D-1677 | 272-290 | 272-290 | CGGCUGUCCGCCCACCCCCUU | 682 | GGGGGUGGGCGGACAGCCGUU | 2185 |
| D-1678 | 273-291 | 273-291 | GGCUGUCCGCCCACCCCCAUU | 683 | UGGGGGUGGGCGGACAGCCUU | 2186 |
| D-1679 | 274-292 | 274-292 | GCUGUCCGCCCACCCCCAUUU | 684 | AUGGGGGUGGGCGGACAGCUU | 2187 |
| D-1680 | 27-45 | 27-45 | UGACUGGCAUGUGUGGGGUU | 685 | CCCCCACACAUGCCAGUCAUU | 2188 |
| D-1681 | 275-293 | 275-293 | CUGUCCGCCCACCCCCAUUUU | 686 | AAUGGGGGUGGGCGGACAGUU | 2189 |
| D-1682 | 276-294 | 276-294 | UGUCCGCCCACCCCCAUUCUU | 687 | GAAUGGGGGUGGGCGGACAUU | 2190 |
| D-1683 | 277-295 | 277-295 | GUCCGCCCACCCCCAUUCUUU | 688 | AGAAUGGGGGUGGGCGGACUU | 2191 |
| D-1684 | 278-296 | 278-296 | UCCGCCCACCCCCAUUCUCUU | 689 | GAGAAUGGGGGUGGGCGGAUU | 2192 |
| D-1685 | 279-297 | 279-297 | CCGCCCACCCCCAUUCUCCUU | 690 | GGAGAAUGGGGGUGGGCGGUU | 2193 |
| D-1686 | 280-298 | 280-298 | CGCCCACCCCCAUUCUCCAUU | 691 | UGGAGAAUGGGGGUGGGCGUU | 2194 |
| D-1687 | 281-299 | 281-299 | GCCCACCCCCAUUCUCCAAUU | 692 | UUGGAGAAUGGGGGUGGGCUU | 2195 |
| D-1688 | 282-300 | 282-300 | CCCACCCCCAUUCUCCAAGUU | 693 | CUUGGAGAAUGGGGGUGGGUU | 2196 |
| D-1689 | 283-301 | 283-301 | CCACCCCCAUUCUCCAAGCUU | 694 | GCUUGGAGAAUGGGGGUGGUU | 2197 |
| D-1690 | 284-302 | 284-302 | CACCCCCAUUCUCCAAGCUUU | 695 | AGCUUGGAGAAUGGGGGUGUU | 2198 |
| D-1691 | 28-46 | 28-46 | GACUGGCAUGUGUGGGGGCUU | 696 | GCCCCCACACAUGCCAGUCUU | 2199 |
| D-1692 | 285-303 | 285-303 | ACCCCCAUUCUCCAAGCUUUU | 697 | AAGCUUGGAGAAUGGGGGUUU | 2200 |
| D-1693 | 286-304 | 286-304 | CCCCCAUUCUCCAAGCUUCUU | 698 | GAAGCUUGGAGAAUGGGGGUU | 2201 |
| D-1694 | 287-305 | 287-305 | CCCCAUUCUCCAAGCUUCAUU | 699 | UGAAGCUUGGAGAAUGGGGUU | 2202 |
| D-1695 | 288-306 | 288-306 | CCCAUUCUCCAAGCUUCAGUU | 700 | CUGAAGCUUGGAGAAUGGGUU | 2203 |
| D-1696 | 289-307 | 289-307 | CCAUUCUCCAAGCUUCAGCUU | 701 | GCUGAAGCUUGGAGAAUGGUU | 2204 |
| D-1697 | 290-308 | 290-308 | CAUUCUCCAAGCUUCAGCCUU | 702 | GGCUGAAGCUUGGAGAAUGUU | 2205 |
| D-1698 | 291-309 | 291-309 | AUUCUCCAAGCUUCAGCCCUU | 703 | GGGCUGAAGCUUGGAGAAUUU | 2206 |
| D-1699 | 292-310 | 292-310 | UUCUCCAAGCUUCAGCCCCUU | 704 | GGGGCUGAAGCUUGGAGAAUU | 2207 |
| D-1700 | 293-311 | 293-311 | UCUCCAAGCUUCAGCCCCCUU | 705 | GGGGGCUGAAGCUUGGAGAUU | 2208 |
| D-1701 | 294-312 | 294-312 | CUCCAAGCUUCAGCCCCCUUU | 706 | AGGGGGCUGAAGCUUGGAGUU | 2209 |
| D-1702 | 29-47 | 29-47 | ACUGGCAUGUGUGGGGGCAUU | 707 | UGCCCCCACACAUGCCAGUUU | 2210 |
| D-1703 | 295-313 | 295-313 | UCCAAGCUUCAGCCCCCUCUU | 708 | GAGGGGGCUGAAGCUUGGAUU | 2211 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1704 | 296-314 | 296-314 | CCAAGCUUCAGCCCCCUCCUU | 709 | GGAGGGGGCUGAAGCUUGGUU | 2212 |
| D-1705 | 297-315 | 297-315 | CAAGCUUCAGCCCCCUCCUUU | 710 | AGGAGGGGGCUGAAGCUUGUU | 2213 |
| D-1706 | 298-316 | 298-316 | AAGCUUCAGCCCCCUCCUUUU | 711 | AAGGAGGGGGCUGAAGCUUUU | 2214 |
| D-1707 | 299-317 | 299-317 | AGCUUCAGCCCCCUCCUUAUU | 712 | UAAGGAGGGGGCUGAAGCUUU | 2215 |
| D-1708 | 300-318 | 300-318 | GCUUCAGCCCCCUCCUUAGUU | 713 | CUAAGGAGGGGCUGAAGCUU | 2216 |
| D-1709 | 301-319 | 301-319 | CUUCAGCCCCCUCCUUAGUUU | 714 | ACUAAGGAGGGGCUGAAGUU | 2217 |
| D-1710 | 302-320 | 302-320 | UUCAGCCCCCUCCUUAGUUUU | 715 | AACUAAGGAGGGGGCUGAAUU | 2218 |
| D-1711 | 303-321 | 303-321 | UCAGCCCCCUCCUUAGUUCUU | 716 | GAACUAAGGAGGGGGCUGAUU | 2219 |
| D-1712 | 304-322 | 304-322 | CAGCCCCCUCCUUAGUUCGUU | 717 | CGAACUAAGGAGGGGGCUGUU | 2220 |
| D-1713 | 30-48 | 30-48 | CUGGCAUGUGUGGGGGCAAUU | 718 | UUGCCCCCACACAUGCCAGUU | 2221 |
| D-1714 | 305-323 | 305-323 | AGCCCCCUCCUUAGUUCGGUU | 719 | CCGAACUAAGGAGGGGGCUUU | 2222 |
| D-1715 | 306-324 | 306-324 | GCCCCCUCCUUAGUUCGGCUU | 720 | GCCGAACUAAGGAGGGGGCUU | 2223 |
| D-1716 | 307-325 | 307-325 | CCCCCUCCUUAGUUCGGCAUU | 721 | UGCCGAACUAAGGAGGGGGUU | 2224 |
| D-1717 | 308-326 | 308-326 | CCCCUCCUUAGUUCGGCAUUU | 722 | AUGCCGAACUAAGGAGGGGUU | 2225 |
| D-1718 | 309-327 | 309-327 | CCCUCCUUAGUUCGGCAUCUU | 723 | GAUGCCGAACUAAGGAGGGUU | 2226 |
| D-1719 | 310-328 | 310-328 | CCUCCUUAGUUCGGCAUCUUU | 724 | AGAUGCCGAACUAAGGAGGUU | 2227 |
| D-1720 | 311-329 | 311-329 | CUCCUUAGUUCGGCAUCUGUU | 725 | CAGAUGCCGAACUAAGGAGUU | 2228 |
| D-1721 | 312-330 | 312-330 | UCCUUAGUUCGGCAUCUGCUU | 726 | GCAGAUGCCGAACUAAGGAUU | 2229 |
| D-1722 | 313-331 | 313-331 | CCUUAGUUCGGCAUCUGCAUU | 727 | UGCAGAUGCCGAACUAAGGUU | 2230 |
| D-1723 | 314-332 | 314-332 | CUUAGUUCGGCAUCUGCACUU | 728 | GUGCAGAUGCCGAACUAAGUU | 2231 |
| D-1724 | 31-49 | 31-49 | UGGCAUGUGUGGGGGCAACUU | 729 | GUUGCCCCCACACAUGCCAUU | 2232 |
| D-1725 | 315-333 | 315-333 | UUAGUUCGGCAUCUGCACAUU | 730 | UGUGCAGAUGCCGAACUAAUU | 2233 |
| D-1726 | 316-334 | 316-334 | UAGUUCGGCAUCUGCACAGUU | 731 | CUGUGCAGAUGCCGAACUAUU | 2234 |
| D-1727 | 317-335 | 317-335 | AGUUCGGCAUCUGCACAGCUU | 732 | GCUGUGCAGAUGCCGAACUUU | 2235 |
| D-1728 | 318-336 | 318-336 | GUUCGGCAUCUGCACAGCAUU | 733 | UGCUGUGCAGAUGCCGAACUU | 2236 |
| D-1729 | 319-337 | 319-337 | UUCGGCAUCUGCACAGCACUU | 734 | GUGCUGUGCAGAUGCCGAAUU | 2237 |
| D-1730 | 320-338 | 320-338 | UCGGCAUCUGCACAGCACUUU | 735 | AGUGCUGUGCAGAUGCCGAUU | 2238 |
| D-1731 | 3-21 | 3-21 | CAAACGGUGCACGGAAGAGUU | 736 | CUCUUCCGUGCACCGUUUGUU | 2239 |
| D-1732 | 321-339 | 321-339 | CGGCAUCUGCACAGCACUGUU | 737 | CAGUGCUGUGCAGAUGCCGUU | 2240 |
| D-1733 | 322-340 | 322-340 | GGCAUCUGCACAGCACUGAUU | 738 | UCAGUGCUGUGCAGAUGCCUU | 2241 |
| D-1734 | 323-341 | 323-341 | GCAUCUGCACAGCACUGAAUU | 739 | UUCAGUGCUGUGCAGAUGCUU | 2242 |
| D-1735 | 324-342 | 324-342 | CAUCUGCACAGCACUGAAGUU | 740 | CUUCAGUGCUGUGCAGAUGUU | 2243 |
| D-1736 | 32-50 | 32-50 | GGCAUGUGUGGGGGCAACAUU | 741 | UGUUGCCCCCACACAUGCCUU | 2244 |
| D-1737 | 325-343 | 325-343 | AUCUGCACAGCACUGAAGAUU | 742 | UCUUCAGUGCUGUGCAGAUUU | 2245 |
| D-1738 | 326-344 | 326-344 | UCUGCACAGCACUGAAGAAUU | 743 | UUCUUCAGUGCUGUGCAGAUU | 2246 |
| D-1739 | 327-345 | 327-345 | CUGCACAGCACUGAAGAACUU | 744 | GUUCUUCAGUGCUGUGCAGUU | 2247 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1740 | 328-346 | 328-346 | UGCACAGCACUGAAGAACCUU | 745 | GGUUCUUCAGUGCUGUGCAUU | 2248 |
| D-1741 | 329-347 | 329-347 | GCACAGCACUGAAGAACCUUU | 746 | AGGUUCUUCAGUGCUGUGCUU | 2249 |
| D-1742 | 330-348 | 330-348 | CACAGCACUGAAGAACCUGUU | 747 | CAGGUUCUUCAGUGCUGUGUU | 2250 |
| D-1743 | 331-349 | 331-349 | ACAGCACUGAAGAACCUGGUU | 748 | CCAGGUUCUUCAGUGCUGUUU | 2251 |
| D-1744 | 332-350 | 332-350 | CAGCACUGAAGAACCUGGGUU | 749 | CCCAGGUUCUUCAGUGCUGUU | 2252 |
| D-1745 | 333-351 | 333-351 | AGCACUGAAGAACCUGGGAUU | 750 | UCCCAGGUUCUUCAGUGCUUU | 2253 |
| D-1746 | 334-352 | 334-352 | GCACUGAAGAACCUGGGAAUU | 751 | UUCCCAGGUUCUUCAGUGCUU | 2254 |
| D-1747 | 33-51 | 33-51 | GCAUGUGUGGGGCAACACUU | 752 | GUGUUGCCCCCACACAUGCUU | 2255 |
| D-1748 | 335-353 | 335-353 | CACUGAAGAACCUGGGAAUUU | 753 | AUUCCCAGGUUCUUCAGUGUU | 2256 |
| D-1749 | 336-354 | 336-354 | ACUGAAGAACCUGGGAAUCUU | 754 | GAUUCCCAGGUUCUUCAGUUU | 2257 |
| D-1750 | 337-355 | 337-355 | CUGAAGAACCUGGGAAUCAUU | 755 | UGAUUCCCAGGUUCUUCAGUU | 2258 |
| D-1751 | 338-356 | 338-356 | UGAAGAACCUGGGAAUCAGUU | 756 | CUGAUUCCCAGGUUCUUCAUU | 2259 |
| D-1752 | 339-357 | 339-357 | GAAGAACCUGGGAAUCAGAUU | 757 | UCUGAUUCCCAGGUUCUUCUU | 2260 |
| D-1753 | 340-358 | 340-358 | AAGAACCUGGGAAUCAGACUU | 758 | GUCUGAUUCCCAGGUUCUUUU | 2261 |
| D-1754 | 341-359 | 341-359 | AGAACCUGGGAAUCAGACCUU | 759 | GGUCUGAUUCCCAGGUUCUUU | 2262 |
| D-1755 | 342-360 | 342-360 | GAACCUGGGAAUCAGACCCUU | 760 | GGGUCUGAUUCCCAGGUUCUU | 2263 |
| D-1756 | 343-361 | 343-361 | AACCUGGGAAUCAGACCCUUU | 761 | AGGGUCUGAUUCCCAGGUUUU | 2264 |
| D-1757 | 344-362 | 344-362 | ACCUGGGAAUCAGACCCUGUU | 762 | CAGGGUCUGAUUCCCAGGUUU | 2265 |
| D-1758 | 34-52 | 34-52 | CAUGUGUGGGGCAACACGUU | 763 | CGUGUUGCCCCCACACAUGUU | 2266 |
| D-1759 | 345-363 | 345-363 | CCUGGGAAUCAGACCCUGAUU | 764 | UCAGGGUCUGAUUCCCAGGUU | 2267 |
| D-1760 | 346-364 | 346-364 | CUGGGAAUCAGACCCUGAGUU | 765 | CUCAGGGUCUGAUUCCCAGUU | 2268 |
| D-1761 | 347-365 | 347-365 | UGGGAAUCAGACCCUGAGAUU | 766 | UCUCAGGGUCUGAUUCCCAUU | 2269 |
| D-1762 | 348-366 | 348-366 | GGGAAUCAGACCCUGAGACUU | 767 | GUCUCAGGGUCUGAUUCCCUU | 2270 |
| D-1763 | 349-367 | 349-367 | GGAAUCAGACCCUGAGACCUU | 768 | GGUCUCAGGGUCUGAUUCCUU | 2271 |
| D-1764 | 350-368 | 350-368 | GAAUCAGACCCUGAGACCCUU | 769 | GGGUCUCAGGGUCUGAUUCUU | 2272 |
| D-1765 | 351-369 | 351-369 | AAUCAGACCCUGAGACCCUUU | 770 | AGGGUCUCAGGGUCUGAUUUU | 2273 |
| D-1766 | 352-370 | 352-370 | AUCAGACCCUGAGACCCUGUU | 771 | CAGGGUCUCAGGGUCUGAUUU | 2274 |
| D-1767 | 353-371 | 353-371 | UCAGACCCUGAGACCCUGAUU | 772 | UCAGGGUCUCAGGGUCUGAUU | 2275 |
| D-1768 | 354-372 | 354-372 | CAGACCCUGAGACCCUGAGUU | 773 | CUCAGGGUCUCAGGGUCUGUU | 2276 |
| D-1769 | 35-53 | 35-53 | AUGUGUGGGGCAACACGAUU | 774 | UCGUGUUGCCCCCACACAUUU | 2277 |
| D-1770 | 355-373 | 355-373 | AGACCCUGAGACCCUGAGCUU | 775 | GCUCAGGGUCUCAGGGUCUUU | 2278 |
| D-1771 | 356-374 | 356-374 | GACCCUGAGACCCUGAGCAUU | 776 | UGCUCAGGGUCUCAGGGUCUU | 2279 |
| D-1772 | 357-375 | 357-375 | ACCCUGAGACCCUGAGCAAUU | 777 | UUGCUCAGGGUCUCAGGGUUU | 2280 |
| D-1773 | 358-376 | 358-376 | CCCUGAGACCCUGAGCAAUUU | 778 | AUUGCUCAGGGUCUCAGGGUU | 2281 |
| D-1774 | 359-377 | 359-377 | CCUGAGACCCUGAGCAAUCUU | 779 | GAUUGCUCAGGGUCUCAGGUU | 2282 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1775 | 360-378 | 360-378 | CUGAGACCCUGAGCAAUCCUU | 780 | GGAUUGCUCAGGGUCUCAGUU | 2283 |
| D-1776 | 361-379 | 361-379 | UGAGACCCUGAGCAAUCCCUU | 781 | GGGAUUGCUCAGGGUCUCAUU | 2284 |
| D-1777 | 362-380 | 362-380 | GAGACCCUGAGCAAUCCCAUU | 782 | UGGGAUUGCUCAGGGUCUCUU | 2285 |
| D-1778 | 363-381 | 363-381 | AGACCCUGAGCAAUCCCAGUU | 783 | CUGGGAUUGCUCAGGGUCUUU | 2286 |
| D-1779 | 364-382 | 364-382 | GACCCUGAGCAAUCCCAGGUU | 784 | CCUGGGAUUGCUCAGGGUCUU | 2287 |
| D-1780 | 365-383 | 365-383 | ACCCUGAGCAAUCCCAGGUUU | 785 | ACCUGGGAUUGCUCAGGGUUU | 2288 |
| D-1781 | 36-54 | 36-54 | UGUGUGGGGGCAACACGAUUU | 786 | AUCGUGUUGCCCCCACACAUU | 2289 |
| D-1782 | 366-384 | 366-384 | CCCUGAGCAAUCCCAGGUCUU | 787 | GACCUGGGAUUGCUCAGGGUU | 2290 |
| D-1783 | 367-385 | 367-385 | CCUGAGCAAUCCCAGGUCCUU | 788 | GGACCUGGGAUUGCUCAGGUU | 2291 |
| D-1784 | 368-386 | 368-386 | CUGAGCAAUCCCAGGUCCAUU | 789 | UGGACCUGGGAUUGCUCAGUU | 2292 |
| D-1785 | 369-387 | 369-387 | UGAGCAAUCCCAGGUCCAGUU | 790 | CUGGACCUGGGAUUGCUCAUU | 2293 |
| D-1786 | 370-388 | 370-388 | GAGCAAUCCCAGGUCCAGCUU | 791 | GCUGGACCUGGGAUUGCUCUU | 2294 |
| D-1787 | 371-389 | 371-389 | AGCAAUCCCAGGUCCAGCGUU | 792 | CGCUGGACCUGGGAUUGCUUU | 2295 |
| D-1788 | 372-390 | 372-390 | GCAAUCCCAGGUCCAGCGCUU | 793 | GCGCUGGACCUGGGAUUGCUU | 2296 |
| D-1789 | 373-391 | 373-391 | CAAUCCCAGGUCCAGCGCCUU | 794 | GGCGCUGGACCUGGGAUUGUU | 2297 |
| D-1790 | 374-392 | 374-392 | AAUCCCAGGUCCAGCGCCAUU | 795 | UGGCGCUGGACCUGGGAUUUU | 2298 |
| D-1791 | 375-393 | 375-393 | AUCCCAGGUCCAGCGCCAGUU | 796 | CUGGCGCUGGACCUGGGAUUU | 2299 |
| D-1792 | 37-55 | 37-55 | GUGUGGGGGCAACACGAUUUU | 797 | AAUCGUGUUGCCCCCACACUU | 2300 |
| D-1793 | 376-394 | 376-394 | UCCCAGGUCCAGCGCCAGCUU | 798 | GCUGGCGCUGGACCUGGGAUU | 2301 |
| D-1794 | 377-395 | 377-395 | CCCAGGUCCAGCGCCAGCCUU | 799 | GGCUGGCGCUGGACCUGGGUU | 2302 |
| D-1795 | 378-396 | 378-396 | CCAGGUCCAGCGCCAGCCCUU | 800 | GGGCUGGCGCUGGACCUGGUU | 2303 |
| D-1796 | 379-397 | 379-397 | CAGGUCCAGCGCCAGCCCUUU | 801 | AGGGCUGGCGCUGGACCUGUU | 2304 |
| D-1797 | 380-398 | 380-398 | AGGUCCAGCGCCAGCCCUAUU | 802 | UAGGGCUGGCGCUGGACCUUU | 2305 |
| D-1798 | 381-399 | 381-399 | GGUCCAGCGCCAGCCCUAUUU | 803 | AUAGGGCUGGCGCUGGACCUU | 2306 |
| D-1799 | 382-400 | 382-400 | GUCCAGCGCCAGCCCUAUCUU | 804 | GAUAGGGCUGGCGCUGGACUU | 2307 |
| D-1800 | 383-401 | 383-401 | UCCAGCGCCAGCCCUAUCAUU | 805 | UGAUAGGGCUGGCGCUGGAUU | 2308 |
| D-1801 | 384-402 | 384-402 | CCAGCGCCAGCCCUAUCAUUU | 806 | AUGAUAGGGCUGGCGCUGGUU | 2309 |
| D-1802 | 385-403 | 385-403 | CAGCGCCAGCCCUAUCAUGUU | 807 | CAUGAUAGGGCUGGCGCUGUU | 2310 |
| D-1803 | 38-56 | 38-56 | UGUGGGGGCAACACGAUUCUU | 808 | GAAUCGUGUUGCCCCCACAUU | 2311 |
| D-1804 | 386-404 | 386-404 | AGCGCCAGCCCUAUCAUGAUU | 809 | UCAUGAUAGGGCUGGCGCUUU | 2312 |
| D-1805 | 387-405 | 387-405 | GCGCCAGCCCUAUCAUGACUU | 810 | GUCAUGAUAGGGCUGGCGCUU | 2313 |
| D-1806 | 388-406 | 388-406 | CGCCAGCCCUAUCAUGACCUU | 811 | GGUCAUGAUAGGGCUGGCGUU | 2314 |
| D-1807 | 389-407 | 389-407 | GCCAGCCCUAUCAUGACCAUU | 812 | UGGUCAUGAUAGGGCUGGCUU | 2315 |
| D-1808 | 390-408 | 390-408 | CCAGCCCUAUCAUGACCAAUU | 813 | UUGGUCAUGAUAGGGCUGGUU | 2316 |
| D-1809 | 391-409 | 391-409 | CAGCCCUAUCAUGACCAAGUU | 814 | CUUGGUCAUGAUAGGGCUGUU | 2317 |
| D-1810 | 392-410 | 392-410 | AGCCCUAUCAUGACCAAGGUU | 815 | CCUUGGUCAUGAUAGGGCUUU | 2318 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1811 | 393-411 | 393-411 | GCCCUAUCAUGACCAAGGAUU | 816 | UCCUUGGUCAUGAUAGGGCUU | 2319 |
| D-1812 | 394-412 | 394-412 | CCCUAUCAUGACCAAGGAGUU | 817 | CUCCUUGGUCAUGAUAGGGUU | 2320 |
| D-1813 | 395-413 | 395-413 | CCUAUCAUGACCAAGGAGUUU | 818 | ACUCCUUGGUCAUGAUAGGUU | 2321 |
| D-1814 | 39-57 | 39-57 | GUGGGGCAACACGAUUCUUU | 819 | AGAAUCGUGUUGCCCCCACUU | 2322 |
| D-1815 | 396-414 | 396-414 | CUAUCAUGACCAAGGAGUAUU | 820 | UACUCCUUGGUCAUGAUAGUU | 2323 |
| D-1816 | 397-415 | 397-415 | UAUCAUGACCAAGGAGUAUUU | 821 | AUACUCCUUGGUCAUGAUAUU | 2324 |
| D-1817 | 398-416 | 398-416 | AUCAUGACCAAGGAGUAUCUU | 822 | GAUACUCCUUGGUCAUGAUUU | 2325 |
| D-1818 | 399-417 | 399-417 | UCAUGACCAAGGAGUAUCAUU | 823 | UGAUACUCCUUGGUCAUGAUU | 2326 |
| D-1819 | 400-418 | 400-418 | CAUGACCAAGGAGUAUCAAUU | 824 | UUGAUACUCCUUGGUCAUGUU | 2327 |
| D-1820 | 401-419 | 401-419 | AUGACCAAGGAGUAUCAAGUU | 825 | CUUGAUACUCCUUGGUCAUUU | 2328 |
| D-1821 | 402-420 | 402-420 | UGACCAAGGAGUAUCAAGAUU | 826 | UCUUGAUACUCCUUGGUCAUU | 2329 |
| D-1822 | 403-421 | 403-421 | GACCAAGGAGUAUCAAGACUU | 827 | GUCUUGAUACUCCUUGGUCUU | 2330 |
| D-1823 | 404-422 | 404-422 | ACCAAGGAGUAUCAAGACCUU | 828 | GGUCUUGAUACUCCUUGGUUU | 2331 |
| D-1824 | 405-423 | 405-423 | CCAAGGAGUAUCAAGACCUUU | 829 | AGGUCUUGAUACUCCUUGGUU | 2332 |
| D-1825 | 40-58 | 40-58 | UGGGGCAACACGAUUCUCUU | 830 | GAGAAUCGUGUUGCCCCCAUU | 2333 |
| D-1826 | 406-424 | 406-424 | CAAGGAGUAUCAAGACCUUUU | 831 | AAGGUCUUGAUACUCCUUGUU | 2334 |
| D-1827 | 407-425 | 407-425 | AAGGAGUAUCAAGACCUUCUU | 832 | GAAGGUCUUGAUACUCCUUUU | 2335 |
| D-1828 | 408-426 | 408-426 | AGGAGUAUCAAGACCUUCAUU | 833 | UGAAGGUCUUGAUACUCCUUU | 2336 |
| D-1829 | 409-427 | 409-427 | GGAGUAUCAAGACCUUCAGUU | 834 | CUGAAGGUCUUGAUACUCCUU | 2337 |
| D-1830 | 410-428 | 410-428 | GAGUAUCAAGACCUUCAGCUU | 835 | GCUGAAGGUCUUGAUACUCUU | 2338 |
| D-1831 | 411-429 | 411-429 | AGUAUCAAGACCUUCAGCAUU | 836 | UGCUGAAGGUCUUGAUACUUU | 2339 |
| D-1832 | 412-430 | 412-430 | GUAUCAAGACCUUCAGCAUUU | 837 | AUGCUGAAGGUCUUGAUACUU | 2340 |
| D-1833 | 413-431 | 413-431 | UAUCAAGACCUUCAGCAUCUU | 838 | GAUGCUGAAGGUCUUGAUAUU | 2341 |
| D-1834 | 414-432 | 414-432 | AUCAAGACCUUCAGCAUCUUU | 839 | AGAUGCUGAAGGUCUUGAUUU | 2342 |
| D-1835 | 415-433 | 415-433 | UCAAGACCUUCAGCAUCUGUU | 840 | CAGAUGCUGAAGGUCUUGAUU | 2343 |
| D-1836 | 41-59 | 41-59 | GGGGCAACACGAUUCUCCUU | 841 | GGAGAAUCGUGUUGCCCCCUU | 2344 |
| D-1837 | 416-434 | 416-434 | CAAGACCUUCAGCAUCUGGUU | 842 | CCAGAUGCUGAAGGUCUUGUU | 2345 |
| D-1838 | 417-435 | 417-435 | AAGACCUUCAGCAUCUGGAUU | 843 | UCCAGAUGCUGAAGGUCUUUU | 2346 |
| D-1839 | 418-436 | 418-436 | AGACCUUCAGCAUCUGGACUU | 844 | GUCCAGAUGCUGAAGGUCUUU | 2347 |
| D-1840 | 419-437 | 419-437 | GACCUUCAGCAUCUGGACAUU | 845 | UGUCCAGAUGCUGAAGGUCUU | 2348 |
| D-1841 | 420-438 | 420-438 | ACCUUCAGCAUCUGGACAAUU | 846 | UUGUCCAGAUGCUGAAGGUUU | 2349 |
| D-1842 | 421-439 | 421-439 | CCUUCAGCAUCUGGACAAUUU | 847 | AUUGUCCAGAUGCUGAAGGUU | 2350 |
| D-1843 | 4-22 | 4-22 | AAACGGUGCACGGAAGAGUUU | 848 | ACUCUUCCGUGCACCGUUUUU | 2351 |
| D-1844 | 422-440 | 422-440 | CUUCAGCAUCUGGACAAUGUU | 849 | CAUUGUCCAGAUGCUGAAGUU | 2352 |
| D-1845 | 423-441 | 423-441 | UUCAGCAUCUGGACAAUGAUU | 850 | UCAUUGUCCAGAUGCUGAAUU | 2353 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1846 | 424-442 | 424-442 | UCAGCAUCUGGACAAUGAGUU | 851 | CUCAUUGUCCAGAUGCUGAUU | 2354 |
| D-1847 | 425-443 | 425-443 | CAGCAUCUGGACAAUGAGGUU | 852 | CCUCAUUGUCCAGAUGCUGUU | 2355 |
| D-1848 | 42-60 | 42-60 | GGGGCAACACGAUUCUCCUUU | 853 | AGGAGAAUCGUGUUGCCCCUU | 2356 |
| D-1849 | 426-444 | 426-444 | AGCAUCUGGACAAUGAGGAUU | 854 | UCCUCAUUGUCCAGAUGCUUU | 2357 |
| D-1850 | 427-445 | 427-445 | GCAUCUGGACAAUGAGGAGUU | 855 | CUCCUCAUUGUCCAGAUGCUU | 2358 |
| D-1851 | 428-446 | 428-446 | CAUCUGGACAAUGAGGAGAUU | 856 | UCUCCUCAUUGUCCAGAUGUU | 2359 |
| D-1852 | 429-447 | 429-447 | AUCUGGACAAUGAGGAGAGUU | 857 | CUCUCCUCAUUGUCCAGAUUU | 2360 |
| D-1853 | 430-448 | 430-448 | UCUGGACAAUGAGGAGAGUUU | 858 | ACUCUCCUCAUUGUCCAGAUU | 2361 |
| D-1854 | 431-449 | 431-449 | CUGGACAAUGAGGAGAGUGUU | 859 | CACUCUCCUCAUUGUCCAGUU | 2362 |
| D-1855 | 432-450 | 432-450 | UGGACAAUGAGGAGAGUGAUU | 860 | UCACUCUCCUCAUUGUCCAUU | 2363 |
| D-1856 | 433-451 | 433-451 | GGACAAUGAGGAGAGUGACUU | 861 | GUCACUCUCCUCAUUGUCCUU | 2364 |
| D-1857 | 434-452 | 434-452 | GACAAUGAGGAGAGUGACCUU | 862 | GGUCACUCUCCUCAUUGUCUU | 2365 |
| D-1858 | 435-453 | 435-453 | ACAAUGAGGAGAGUGACCAUU | 863 | UGGUCACUCUCCUCAUUGUUU | 2366 |
| D-1859 | 43-61 | 43-61 | GGGCAACACGAUUCUCCUCUU | 864 | GAGGAGAAUCGUGUUGCCCUU | 2367 |
| D-1860 | 436-454 | 436-454 | CAAUGAGGAGAGUGACCACUU | 865 | GUGGUCACUCUCCUCAUUGUU | 2368 |
| D-1861 | 437-455 | 437-455 | AAUGAGGAGAGUGACCACCUU | 866 | GGUGGUCACUCUCCUCAUUUU | 2369 |
| D-1862 | 438-456 | 438-456 | AUGAGGAGAGUGACCACCAUU | 867 | UGGUGGUCACUCUCCUCAUUU | 2370 |
| D-1863 | 439-457 | 439-457 | UGAGGAGAGUGACCACCAUUU | 868 | AUGGUGGUCACUCUCCUCAUU | 2371 |
| D-1864 | 440-458 | 440-458 | GAGGAGAGUGACCACCAUCUU | 869 | GAUGGUGGUCACUCUCCUCUU | 2372 |
| D-1865 | 441-459 | 441-459 | AGGAGAGUGACCACCAUCAUU | 870 | UGAUGGUGGUCACUCUCCUUU | 2373 |
| D-1866 | 442-460 | 442-460 | GGAGAGUGACCACCAUCAGUU | 871 | CUGAUGGUGGUCACUCUCCUU | 2374 |
| D-1867 | 443-461 | 443-461 | GAGAGUGACCACCAUCAGCUU | 872 | GCUGAUGGUGGUCACUCUCUU | 2375 |
| D-1868 | 444-462 | 444-462 | AGAGUGACCACCAUCAGCUUU | 873 | AGCUGAUGGUGGUCACUCUUU | 2376 |
| D-1869 | 445-463 | 445-463 | GAGUGACCACCAUCAGCUCUU | 874 | GAGCUGAUGGUGGUCACUCUU | 2377 |
| D-1870 | 44-62 | 44-62 | GGCAACACGAUUCUCCUCCUU | 875 | GGAGGAGAAUCGUGUUGCCUU | 2378 |
| D-1871 | 446-464 | 446-464 | AGUGACCACCAUCAGCUCAUU | 876 | UGAGCUGAUGGUGGUCACUUU | 2379 |
| D-1872 | 447-465 | 447-465 | GUGACCACCAUCAGCUCAGUU | 877 | CUGAGCUGAUGGUGGUCACUU | 2380 |
| D-1873 | 448-466 | 448-466 | UGACCACCAUCAGCUCAGAUU | 878 | UCUGAGCUGAUGGUGGUCAUU | 2381 |
| D-1874 | 449-467 | 449-467 | GACCACCAUCAGCUCAGAAUU | 879 | UUCUGAGCUGAUGGUGGUCUU | 2382 |
| D-1875 | 450-468 | 450-468 | ACCACCAUCAGCUCAGAAAUU | 880 | UUUCUGAGCUGAUGGUGGUUU | 2383 |
| D-1876 | 451-469 | 451-469 | CCACCAUCAGCUCAGAAAAUU | 881 | UUUUCUGAGCUGAUGGUGGUU | 2384 |
| D-1877 | 452-470 | 452-470 | CACCAUCAGCUCAGAAAAGUU | 882 | CUUUUCUGAGCUGAUGGUGUU | 2385 |
| D-1878 | 453-471 | — | ACCAUCAGCUCAGAAAAGGUU | 883 | CCUUUUCUGAGCUGAUGGUUU | 2386 |
| D-1879 | 454-472 | — | CCAUCAGCUCAGAAAAGGGUU | 884 | CCCUUUUCUGAGCUGAUGGUU | 2387 |
| D-1880 | 455-473 | — | CAUCAGCUCAGAAAAGGGCUU | 885 | GCCCUUUUCUGAGCUGAUGUU | 2388 |
| D-1881 | 45-63 | 45-63 | GCAACACGAUUCUCCUCCCUU | 886 | GGGAGGAGAAUCGUGUUGCUU | 2389 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1882 | 456-474 | — | AUCAGCUCAGAAAAGGGCCUU | 887 | GGCCCUUUUCUGAGCUGAUUU | 2390 |
| D-1883 | 457-475 | — | UCAGCUCAGAAAAGGGCCAUU | 888 | UGGCCCUUUUCUGAGCUGAUU | 2391 |
| D-1884 | 458-476 | — | CAGCUCAGAAAAGGGCCACUU | 889 | GUGGCCCUUUUCUGAGCUGUU | 2392 |
| D-1885 | 459-477 | — | AGCUCAGAAAAGGGCCACCUU | 890 | GGUGGCCCUUUUCUGAGCUUU | 2393 |
| D-1886 | 460-478 | — | GCUCAGAAAAGGGCCACCUUU | 891 | AGGUGGCCCUUUUCUGAGCUU | 2394 |
| D-1887 | 461-479 | — | CUCAGAAAAGGGCCACCUCUU | 892 | GAGGUGGCCCUUUUCUGAGUU | 2395 |
| D-1888 | 462-480 | — | UCAGAAAAGGGCCACCUCCUU | 893 | GGAGGUGGCCCUUUUCUGAUU | 2396 |
| D-1889 | 463-481 | — | CAGAAAAGGGCCACCUCCUUU | 894 | AGGAGGUGGCCCUUUUCUGUU | 2397 |
| D-1890 | 464-482 | — | AGAAAAGGGCCACCUCCUCUU | 895 | GAGGAGGUGGCCCUUUUCUUU | 2398 |
| D-1891 | 465-483 | — | GAAAAGGGCCACCUCCUCCUU | 896 | GGAGGAGGUGGCCCUUUUCUU | 2399 |
| D-1892 | 46-64 | 46-64 | CAACACGAUUCUCCUCCCUUU | 897 | AGGGAGGAGAAUCGUGUUGUU | 2400 |
| D-1893 | 466-484 | — | AAAAGGGCCACCUCCUCCCUU | 898 | GGGAGGAGGUGGCCCUUUUUU | 2401 |
| D-1894 | 467-485 | — | AAAGGGCCACCUCCUCCCCUU | 899 | GGGGAGGAGGUGGCCCUUUUU | 2402 |
| D-1895 | 468-486 | — | AAGGGCCACCUCCUCCCCAUU | 900 | UGGGGAGGAGGUGGCCCUUUU | 2403 |
| D-1896 | 469-487 | — | AGGGCCACCUCCUCCCCAGUU | 901 | CUGGGGAGGAGGUGGCCCUUU | 2404 |
| D-1897 | 470-488 | — | GGGCCACCUCCUCCCCAGCUU | 902 | GCUGGGGAGGAGGUGGCCCUU | 2405 |
| D-1898 | 471-489 | — | GGCCACCUCCUCCCCAGCCUU | 903 | GGCUGGGGAGGAGGUGGCCUU | 2406 |
| D-1899 | 472-490 | — | GCCACCUCCUCCCCAGCCCUU | 904 | GGGCUGGGGAGGAGGUGGCUU | 2407 |
| D-1900 | 473-491 | — | CCACCUCCUCCCCAGCCCCUU | 905 | GGGGCUGGGGAGGAGGUGGUU | 2408 |
| D-1901 | 474-492 | — | CACCUCCUCCCCAGCCCCUUU | 906 | AGGGGCUGGGGAGGAGGUGUU | 2409 |
| D-1902 | 475-493 | — | ACCUCCUCCCCAGCCCCUCUU | 907 | GAGGGGCUGGGGAGGAGGUUU | 2410 |
| D-1903 | 476-494 | — | CCUCCUCCCCAGCCCCUCCUU | 908 | GGAGGGGCUGGGGAGGAGGUU | 2411 |
| D-1904 | 47-65 | 47-65 | AACACGAUUCUCCUCCCUGUU | 909 | CAGGGAGGAGAAUCGUGUUUU | 2412 |
| D-1905 | 477-495 | — | CUCCUCCCCAGCCCCUCCUUU | 910 | AGGAGGGGCUGGGGAGGAGUU | 2413 |
| D-1906 | 478-496 | — | UCCUCCCCAGCCCCUCCUGUU | 911 | CAGGAGGGGCUGGGGAGGAUU | 2414 |
| D-1907 | 479-497 | — | CCUCCCCAGCCCCUCCUGCUU | 912 | GCAGGAGGGGCUGGGGAGGUU | 2415 |
| D-1908 | 480-498 | — | CUCCCCAGCCCCUCCUGCAUU | 913 | UGCAGGAGGGGCUGGGGAGUU | 2416 |
| D-1909 | 481-499 | — | UCCCCAGCCCCUCCUGCAGUU | 914 | CUGCAGGAGGGGCUGGGGAUU | 2417 |
| D-1910 | 482-500 | — | CCCCAGCCCCUCCUGCAGCUU | 915 | GCUGCAGGAGGGGCUGGGGUU | 2418 |
| D-1911 | 483-501 | — | CCCAGCCCCUCCUGCAGCGUU | 916 | CGCUGCAGGAGGGGCUGGGUU | 2419 |
| D-1912 | 484-502 | — | CCAGCCCCUCCUGCAGCGUUU | 917 | ACGCUGCAGGAGGGGCUGGUU | 2420 |
| D-1913 | 485-503 | — | CAGCCCCUCCUGCAGCGUCUU | 918 | GACGCUGCAGGAGGGGCUGUU | 2421 |
| D-1914 | 486-504 | — | AGCCCCUCCUGCAGCGUCUUU | 919 | AGACGCUGCAGGAGGGGCUUU | 2422 |
| D-1915 | 48-66 | 48-66 | ACACGAUUCUCCUCCCUGGUU | 920 | CCAGGGAGGAGAAUCGUGUUU | 2423 |
| D-1916 | 487-505 | — | GCCCCUCCUGCAGCGUCUCUU | 921 | GAGACGCUGCAGGAGGGGCUU | 2424 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1917 | 488-506 | — | CCCCUCCUGCAGCGUCUCUUU | 922 | AGAGACGCUGCAGGAGGGGUU | 2425 |
| D-1918 | 489-507 | — | CCCUCCUGCAGCGUCUCUGUU | 923 | CAGAGACGCUGCAGGAGGGUU | 2426 |
| D-1919 | 490-508 | — | CCUCCUGCAGCGUCUCUGCUU | 924 | GCAGAGACGCUGCAGGAGGUU | 2427 |
| D-1920 | 491-509 | — | CUCCUGCAGCGUCUCUGCUUU | 925 | AGCAGAGACGCUGCAGGAGUU | 2428 |
| D-1921 | 492-510 | — | UCCUGCAGCGUCUCUGCUCUU | 926 | GAGCAGAGACGCUGCAGGAUU | 2429 |
| D-1922 | 493-511 | — | CCUGCAGCGUCUCUGCUCCUU | 927 | GGAGCAGAGACGCUGCAGGUU | 2430 |
| D-1923 | 494-512 | — | CUGCAGCGUCUCUGCUCCGUU | 928 | CGGAGCAGAGACGCUGCAGUU | 2431 |
| D-1924 | 495-513 | — | UGCAGCGUCUCUGCUCCGGUU | 929 | CCGGAGCAGAGACGCUGCAUU | 2432 |
| D-1925 | 496-514 | — | GCAGCGUCUCUGCUCCGGAUU | 930 | UCCGGAGCAGAGACGCUGCUU | 2433 |
| D-1926 | 49-67 | 49-67 | CACGAUUCUCCUCCCUGGGUU | 931 | CCCAGGGAGGAGAAUCGUGUU | 2434 |
| D-1927 | 497-515 | — | CAGCGUCUCUGCUCCGGACUU | 932 | GUCCGGAGCAGAGACGCUGUU | 2435 |
| D-1928 | 498-516 | — | AGCGUCUCUGCUCCGGACCUU | 933 | GGUCCGGAGCAGAGACGCUUU | 2436 |
| D-1929 | 499-517 | — | GCGUCUCUGCUCCGGACCUUU | 934 | AGGUCCGGAGCAGAGACGCUU | 2437 |
| D-1930 | 500-518 | — | CGUCUCUGCUCCGGACCUCUU | 935 | GAGGUCCGGAGCAGAGACGUU | 2438 |
| D-1931 | 501-519 | — | GUCUCUGCUCCGGACCUCGUU | 936 | CGAGGUCCGGAGCAGAGACUU | 2439 |
| D-1932 | 502-520 | — | UCUCUGCUCCGGACCUCGCUU | 937 | GCGAGGUCCGGAGCAGAGAUU | 2440 |
| D-1933 | 503-521 | — | CUCUGCUCCGGACCUCGCCUU | 938 | GGCGAGGUCCGGAGCAGAGUU | 2441 |
| D-1934 | 504-522 | — | UCUGCUCCGGACCUCGCCUUU | 939 | AGGCGAGGUCCGGAGCAGAUU | 2442 |
| D-1935 | 505-523 | — | CUGCUCCGGACCUCGCCUCUU | 940 | GAGGCGAGGUCCGGAGCAGUU | 2443 |
| D-1936 | 506-524 | — | UGCUCCGGACCUCGCCUCCUU | 941 | GGAGGCGAGGUCCGGAGCAUU | 2444 |
| D-1937 | 50-68 | 50-68 | ACGAUUCUCCUCCCUGGGGUU | 942 | CCCCAGGGAGGAGAAUCGUUU | 2445 |
| D-1938 | 507-525 | — | GCUCCGGACCUCGCCUCCUUU | 943 | AGGAGGCGAGGUCCGGAGCUU | 2446 |
| D-1939 | 508-526 | — | CUCCGGACCUCGCCUCCUCUU | 944 | GAGGAGGCGAGGUCCGGAGUU | 2447 |
| D-1940 | 509-527 | — | UCCGGACCUCGCCUCCUCCUU | 945 | GGAGGAGGCGAGGUCCGGAUU | 2448 |
| D-1941 | 510-528 | — | CCGGACCUCGCCUCCUCCUUU | 946 | AGGAGGAGGCGAGGUCCGGUU | 2449 |
| D-1942 | 511-529 | — | CGGACCUCGCCUCCUCCUGUU | 947 | CAGGAGGAGGCGAGGUCCGUU | 2450 |
| D-1943 | 512-530 | — | GGACCUCGCCUCCUCCUGCUU | 948 | GCAGGAGGAGGCGAGGUCCUU | 2451 |
| D-1944 | 513-531 | — | GACCUCGCCUCCUCCUGCUUU | 949 | AGCAGGAGGAGGCGAGGUCUU | 2452 |
| D-1945 | 514-532 | — | ACCUCGCCUCCUCCUGCUCUU | 950 | GAGCAGGAGGAGGCGAGGUUU | 2453 |
| D-1946 | 515-533 | — | CCUCGCCUCCUCCUGCUCUUU | 951 | AGAGCAGGAGGAGGCGAGGUU | 2454 |
| D-1947 | 516-534 | — | CUCGCCUCCUCCUGCUCUCUU | 952 | GAGAGCAGGAGGAGGCGAGUU | 2455 |
| D-1948 | 51-69 | 51-69 | CGAUUCUCCUCCCUGGGGAUU | 953 | UCCCCAGGGAGGAGAAUCGUU | 2456 |
| D-1949 | 517-535 | — | UCGCCUCCUCCUGCUCUCCUU | 954 | GGAGAGCAGGAGGAGGCGAUU | 2457 |
| D-1950 | 518-536 | — | CGCCUCCUCCUGCUCUCCCUU | 955 | GGGAGAGCAGGAGGAGGCGUU | 2458 |
| D-1951 | 519-537 | — | GCCUCCUCCUGCUCUCCCUUU | 956 | AGGGAGAGCAGGAGGAGGCUU | 2459 |
| D-1952 | 520-538 | — | CCUCCUCCUGCUCUCCCUGUU | 957 | CAGGGAGAGCAGGAGGAGGUU | 2460 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1953 | 521-539 | — | CUCCUCCUGCUCUCCCUGGUU | 958 | CCAGGGAGAGCAGGAGGAGUU | 2461 |
| D-1954 | 522-540 | — | UCCUCCUGCUCUCCCUGGGUU | 959 | CCCAGGGAGAGCAGGAGGAUU | 2462 |
| D-1955 | 5-23 | 5-23 | AACGGUGCACGGAAGAGUGUU | 960 | CACUCUUCCGUGCACCGUUUU | 2463 |
| D-1956 | 523-541 | — | CCUCCUGCUCUCCCUGGGCUU | 961 | GCCCAGGGAGAGCAGGAGGUU | 2464 |
| D-1957 | 524-542 | — | CUCCUGCUCUCCCUGGGCCUU | 962 | GGCCCAGGGAGAGCAGGAGUU | 2465 |
| D-1958 | 525-543 | — | UCCUGCUCUCCCUGGGCCUUU | 963 | AGGCCCAGGGAGAGCAGGAUU | 2466 |
| D-1959 | 526-544 | — | CCUGCUCUCCCUGGGCCUCUU | 964 | GAGGCCCAGGGAGAGCAGGUU | 2467 |
| D-1960 | 52-70 | 52-70 | GAUUCUCCUCCCUGGGGAGUU | 965 | CUCCCCAGGGAGGAGAAUCUU | 2468 |
| D-1961 | 527-545 | — | CUGCUCUCCCUGGGCCUCAUU | 966 | UGAGGCCCAGGGAGAGCAGUU | 2469 |
| D-1962 | 528-546 | — | UGCUCUCCCUGGGCCUCAGUU | 967 | CUGAGGCCCAGGGAGAGCAUU | 2470 |
| D-1963 | 529-547 | — | GCUCUCCCUGGGCCUCAGCUU | 968 | GCUGAGGCCCAGGGAGAGCUU | 2471 |
| D-1964 | 530-548 | — | CUCUCCCUGGGCCUCAGCCUU | 969 | GGCUGAGGCCCAGGGAGAGUU | 2472 |
| D-1965 | 531-549 | — | UCUCCCUGGGCCUCAGCCUUU | 970 | AGGCUGAGGCCCAGGGAGAUU | 2473 |
| D-1966 | 532-550 | — | CUCCCUGGGCCUCAGCCUCUU | 971 | GAGGCUGAGGCCCAGGGAGUU | 2474 |
| D-1967 | 533-551 | — | UCCCUGGGCCUCAGCCUCCUU | 972 | GGAGGCUGAGGCCCAGGGAUU | 2475 |
| D-1968 | 534-552 | — | CCCUGGGCCUCAGCCUCCUUU | 973 | AGGAGGCUGAGGCCCAGGGUU | 2476 |
| D-1969 | 535-553 | — | CCUGGGCCUCAGCCUCCUGUU | 974 | CAGGAGGCUGAGGCCCAGGUU | 2477 |
| D-1970 | 536-554 | — | CUGGGCCUCAGCCUCCUGCUU | 975 | GCAGGAGGCUGAGGCCCAGUU | 2478 |
| D-1971 | 53-71 | 53-71 | AUUCUCCUCCCUGGGGAGCUU | 976 | GCUCCCCAGGGAGGAGAAUUU | 2479 |
| D-1972 | 537-555 | — | UGGGCCUCAGCCUCCUGCUUU | 977 | AGCAGGAGGCUGAGGCCCAUU | 2480 |
| D-1973 | 538-556 | — | GGGCCUCAGCCUCCUGCUGUU | 978 | CAGCAGGAGGCUGAGGCCCUU | 2481 |
| D-1974 | 539-557 | — | GGCCUCAGCCUCCUGCUGCUU | 979 | GCAGCAGGAGGCUGAGGCCUU | 2482 |
| D-1975 | 540-558 | — | GCCUCAGCCUCCUGCUGCUUU | 980 | AGCAGCAGGAGGCUGAGGCUU | 2483 |
| D-1976 | 541-559 | — | CCUCAGCCUCCUGCUGCUUUU | 981 | AAGCAGCAGGAGGCUGAGGUU | 2484 |
| D-1977 | 542-560 | — | CUCAGCCUCCUGCUGCUUGUU | 982 | CAAGCAGCAGGAGGCUGAGUU | 2485 |
| D-1978 | 543-561 | — | UCAGCCUCCUGCUGCUUGUUU | 983 | ACAAGCAGCAGGAGGCUGAUU | 2486 |
| D-1979 | 544-562 | — | CAGCCUCCUGCUGCUUGUGUU | 984 | CACAAGCAGCAGGAGGCUGUU | 2487 |
| D-1980 | 545-563 | — | AGCCUCCUGCUGCUUGUGGUU | 985 | CCACAAGCAGCAGGAGGCUUU | 2488 |
| D-1981 | 546-564 | — | GCCUCCUGCUGCUUGUGGUUU | 986 | ACCACAAGCAGCAGGAGGCUU | 2489 |
| D-1982 | 54-72 | 54-72 | UUCUCCUCCCUGGGGAGCAUU | 987 | UGCUCCCCAGGGAGGAGAAUU | 2490 |
| D-1983 | 547-565 | — | CCUCCUGCUGCUUGUGGUUUU | 988 | AACCACAAGCAGCAGGAGGUU | 2491 |
| D-1984 | 548-566 | — | CUCCUGCUGCUUGUGGUUGUU | 989 | CAACCACAAGCAGCAGGAGUU | 2492 |
| D-1985 | 549-567 | — | UCCUGCUGCUUGUGGUUGUUU | 990 | ACAACCACAAGCAGCAGGAUU | 2493 |
| D-1986 | 550-568 | — | CCUGCUGCUUGUGGUUGUCUU | 991 | GACAACCACAAGCAGCAGGUU | 2494 |
| D-1987 | 551-569 | — | CUGCUGCUUGUGGUUGUCUUU | 992 | AGACAACCACAAGCAGCAGUU | 2495 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-1988 | 552-570 | — | UGCUGCUUGUGGUUGUCUGUU | 993 | CAGACAACCACAAGCAGCAUU | 2496 |
| D-1989 | 553-571 | — | GCUGCUUGUGGUUGUCUGUUU | 994 | ACAGACAACCACAAGCAGCUU | 2497 |
| D-1990 | 554-572 | — | CUGCUUGUGGUUGUCUGUGUU | 995 | CACAGACAACCACAAGCAGUU | 2498 |
| D-1991 | 555-573 | — | UGCUUGUGGUUGUCUGUGUUU | 996 | ACACAGACAACCACAAGCAUU | 2499 |
| D-1992 | 556-574 | — | GCUUGUGGUUGUCUGUGUGUU | 997 | CACACAGACAACCACAAGCUU | 2500 |
| D-1993 | 55-73 | 55-73 | UCUCCUCCCUGGGGAGCAGUU | 998 | CUGCUCCCCAGGGAGGAGAUU | 2501 |
| D-1994 | 557-575 | — | CUUGUGGUUGUCUGUGUGAUU | 999 | UCACACAGACAACCACAAGUU | 2502 |
| D-1995 | 558-576 | — | UUGUGGUUGUCUGUGUGAUUU | 1000 | AUCACACAGACAACCACAAUU | 2503 |
| D-1996 | 559-577 | — | UGUGGUUGUCUGUGUGAUCUU | 1001 | GAUCACACAGACAACCACAUU | 2504 |
| D-1997 | 560-578 | — | GUGGUUGUCUGUGUGAUCGUU | 1002 | CGAUCACACAGACAACCACUU | 2505 |
| D-1998 | 561-579 | — | UGGUUGUCUGUGUGAUCGGUU | 1003 | CCGAUCACACAGACAACCAUU | 2506 |
| D-1999 | 562-580 | — | GGUUGUCUGUGUGAUCGGAUU | 1004 | UCCGAUCACACAGACAACCUU | 2507 |
| D-2000 | 563-581 | — | GUUGUCUGUGUGAUCGGAUUU | 1005 | AUCCGAUCACACAGACAACUU | 2508 |
| D-2001 | 564-582 | — | UUGUCUGUGUGAUCGGAUCUU | 1006 | GAUCCGAUCACACAGACAAUU | 2509 |
| D-2002 | 565-583 | — | UGUCUGUGUGAUCGGAUCCUU | 1007 | GGAUCCGAUCACACAGACAUU | 2510 |
| D-2003 | 566-584 | — | GUCUGUGUGAUCGGAUCCCUU | 1008 | GGGAUCCGAUCACACAGACUU | 2511 |
| D-2004 | 56-74 | 56-74 | CUCCUCCCUGGGGAGCAGAUU | 1009 | UCUGCUCCCCAGGGAGGAGUU | 2512 |
| D-2005 | 567-585 | — | UCUGUGUGAUCGGAUCCCAUU | 1010 | UGGGAUCCGAUCACACAGAUU | 2513 |
| D-2006 | 568-586 | — | CUGUGUGAUCGGAUCCCAAUU | 1011 | UUGGGAUCCGAUCACACAGUU | 2514 |
| D-2007 | 569-587 | — | UGUGUGAUCGGAUCCCAAAUU | 1012 | UUUGGGAUCCGAUCACACAUU | 2515 |
| D-2008 | 570-588 | — | GUGUGAUCGGAUCCCAAAAUU | 1013 | UUUUGGGAUCCGAUCACACUU | 2516 |
| D-2009 | 571-589 | — | UGUGAUCGGAUCCCAAAACUU | 1014 | GUUUUGGGAUCCGAUCACAUU | 2517 |
| D-2010 | 572-590 | — | GUGAUCGGAUCCCAAAACUUU | 1015 | AGUUUUGGGAUCCGAUCACUU | 2518 |
| D-2011 | 573-591 | — | UGAUCGGAUCCCAAAACUCUU | 1016 | GAGUUUUGGGAUCCGAUCAUU | 2519 |
| D-2012 | 574-592 | — | GAUCGGAUCCCAAAACUCCUU | 1017 | GGAGUUUUGGGAUCCGAUCUU | 2520 |
| D-2013 | 575-593 | — | AUCGGAUCCCAAAACUCCCUU | 1018 | GGGAGUUUUGGGAUCCGAUUU | 2521 |
| D-2014 | 576-594 | — | UCGGAUCCCAAAACUCCCAUU | 1019 | UGGGAGUUUUGGGAUCCGAUU | 2522 |
| D-2015 | 57-75 | 57-75 | UCCUCCCUGGGGAGCAGAGUU | 1020 | CUCUGCUCCCCAGGGAGGAUU | 2523 |
| D-2016 | 577-595 | — | CGGAUCCCAAAACUCCCAGUU | 1021 | CUGGGAGUUUUGGGAUCCGUU | 2524 |
| D-2017 | 578-596 | — | GGAUCCCAAAACUCCCAGCUU | 1022 | GCUGGGAGUUUUGGGAUCCUU | 2525 |
| D-2018 | 579-597 | — | GAUCCCAAAACUCCCAGCUUU | 1023 | AGCUGGGAGUUUUGGGAUCUU | 2526 |
| D-2019 | 580-598 | — | AUCCCAAAACUCCCAGCUGUU | 1024 | CAGCUGGGAGUUUUGGGAUUU | 2527 |
| D-2020 | 581-599 | — | UCCCAAAACUCCCAGCUGCUU | 1025 | GCAGCUGGGAGUUUUGGGAUU | 2528 |
| D-2021 | 582-600 | — | CCCAAAACUCCCAGCUGCAUU | 1026 | UGCAGCUGGGAGUUUUGGGUU | 2529 |
| D-2022 | 583-601 | — | CCAAAACUCCCAGCUGCAGUU | 1027 | CUGCAGCUGGGAGUUUUGGUU | 2530 |
| D-2023 | 584-602 | — | CAAAACUCCCAGCUGCAGGUU | 1028 | CCUGCAGCUGGGAGUUUUGUU | 2531 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-2024 | 585-603 | — | AAAACUCCCAGCUGCAGGAUU | 1029 | UCCUGCAGCUGGGAGUUUUUU | 2532 |
| D-2025 | 586-604 | — | AAACUCCCAGCUGCAGGAGUU | 1030 | CUCCUGCAGCUGGGAGUUUUU | 2533 |
| D-2026 | 58-76 | 58-76 | CCUCCCUGGGGAGCAGAGCUU | 1031 | GCUCUGCUCCCCAGGGAGGUU | 2534 |
| D-2027 | 587-605 | — | AACUCCCAGCUGCAGGAGGUU | 1032 | CCUCCUGCAGCUGGGAGUUUU | 2535 |
| D-2028 | 588-606 | 471-489 | ACUCCCAGCUGCAGGAGGAUU | 1033 | UCCUCCUGCAGCUGGGAGUUU | 2536 |
| D-2029 | 589-607 | 472-490 | CUCCCAGCUGCAGGAGGAGUU | 1034 | CUCCUCCUGCAGCUGGGAGUU | 2537 |
| D-2030 | 590-608 | 473-491 | UCCCAGCUGCAGGAGGAGCUU | 1035 | GCUCCUCCUGCAGCUGGGAUU | 2538 |
| D-2031 | 591-609 | 474-492 | CCCAGCUGCAGGAGGAGCUUU | 1036 | AGCUCCUCCUGCAGCUGGGUU | 2539 |
| D-2032 | 592-610 | 475-493 | CCAGCUGCAGGAGGAGCUGUU | 1037 | CAGCUCCUCCUGCAGCUGGUU | 2540 |
| D-2033 | 593-611 | 476-494 | CAGCUGCAGGAGGAGCUGCUU | 1038 | GCAGCUCCUCCUGCAGCUGUU | 2541 |
| D-2034 | 594-612 | 477-495 | AGCUGCAGGAGGAGCUGCGUU | 1039 | CGCAGCUCCUCCUGCAGCUUU | 2542 |
| D-2035 | 595-613 | 478-496 | GCUGCAGGAGGAGCUGCGGUU | 1040 | CCGCAGCUCCUCCUGCAGCUU | 2543 |
| D-2036 | 596-614 | 479-497 | CUGCAGGAGGAGCUGCGGGUU | 1041 | CCCGCAGCUCCUCCUGCAGUU | 2544 |
| D-2037 | 597-615 | 480-498 | UGCAGGAGGAGCUGCGGGGUU | 1042 | CCCCGCAGCUCCUCCUGCAUU | 2545 |
| D-2038 | 59-77 | 59-77 | CUCCCUGGGGAGCAGAGCAUU | 1043 | UGCUCUGCUCCCCAGGGAGUU | 2546 |
| D-2039 | 598-616 | 481-499 | GCAGGAGGAGCUGCGGGGCUU | 1044 | GCCCCGCAGCUCCUCCUGCUU | 2547 |
| D-2040 | 599-617 | 482-500 | CAGGAGGAGCUGCGGGGCCUU | 1045 | GGCCCCGCAGCUCCUCCUGUU | 2548 |
| D-2041 | 600-618 | 483-501 | AGGAGGAGCUGCGGGGCCUUU | 1046 | AGGCCCCGCAGCUCCUCCUUU | 2549 |
| D-2042 | 601-619 | 484-502 | GGAGGAGCUGCGGGGCCUGUU | 1047 | CAGGCCCCGCAGCUCCUCCUU | 2550 |
| D-2043 | 602-620 | 485-503 | GAGGAGCUGCGGGGCCUGAUU | 1048 | UCAGGCCCCGCAGCUCCUCUU | 2551 |
| D-2044 | 603-621 | 486-504 | AGGAGCUGCGGGGCCUGAGUU | 1049 | CUCAGGCCCCGCAGCUCCUUU | 2552 |
| D-2045 | 604-622 | 487-505 | GGAGCUGCGGGGCCUGAGAUU | 1050 | UCUCAGGCCCCGCAGCUCCUU | 2553 |
| D-2046 | 605-623 | 488-506 | GAGCUGCGGGGCCUGAGAGUU | 1051 | CUCUCAGGCCCCGCAGCUCUU | 2554 |
| D-2047 | 606-624 | 489-507 | AGCUGCGGGGCCUGAGAGAUU | 1052 | UCUCUCAGGCCCCGCAGCUUU | 2555 |
| D-2048 | 607-625 | 490-508 | GCUGCGGGGCCUGAGAGAGUU | 1053 | CUCUCUCAGGCCCCGCAGCUU | 2556 |
| D-2049 | 60-78 | 60-78 | UCCCUGGGGAGCAGAGCAGUU | 1054 | CUGCUCUGCUCCCCAGGGAUU | 2557 |
| D-2050 | 608-626 | 491-509 | CUGCGGGGCCUGAGAGAGAUU | 1055 | UCUCUCUCAGGCCCCGCAGUU | 2558 |
| D-2051 | 609-627 | 492-510 | UGCGGGGCCUGAGAGAGACUU | 1056 | GUCUCUCUCAGGCCCCGCAUU | 2559 |
| D-2052 | 610-628 | 493-511 | GCGGGGCCUGAGAGAGACGUU | 1057 | CGUCUCUCUCAGGCCCCGCUU | 2560 |
| D-2053 | 611-629 | 494-512 | CGGGGCCUGAGAGAGACGUUU | 1058 | ACGUCUCUCUCAGGCCCCGUU | 2561 |
| D-2054 | 612-630 | 495-513 | GGGGCCUGAGAGAGACGUUUU | 1059 | AACGUCUCUCUCAGGCCCCUU | 2562 |
| D-2055 | 613-631 | 496-514 | GGGCCUGAGAGAGACGUUCUU | 1060 | GAACGUCUCUCUCAGGCCCUU | 2563 |
| D-2056 | 614-632 | 497-515 | GGCCUGAGAGAGACGUUCAUU | 1061 | UGAACGUCUCUCUCAGGCCUU | 2564 |
| D-2057 | 615-633 | 498-516 | GCCUGAGAGAGACGUUCAGUU | 1062 | CUGAACGUCUCUCUCAGGCUU | 2565 |
| D-2058 | 616-634 | 499-517 | CCUGAGAGAGACGUUCAGCUU | 1063 | GCUGAACGUCUCUCUCAGGUU | 2566 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-2059 | 617-635 | 500-518 | CUGAGAGAGACGUUCAGCAUU | 1064 | UGCUGAACGUCUCUCUCAGUU | 2567 |
| D-2060 | 61-79 | 61-79 | CCCUGGGGAGCAGAGCAGAUU | 1065 | UCUGCUCUGCUCCCCAGGGUU | 2568 |
| D-2061 | 618-636 | 501-519 | UGAGAGAGACGUUCAGCAAUU | 1066 | UUGCUGAACGUCUCUCUCAUU | 2569 |
| D-2062 | 619-637 | 502-520 | GAGAGAGACGUUCAGCAACUU | 1067 | GUUGCUGAACGUCUCUCUCUU | 2570 |
| D-2063 | 620-638 | 503-521 | AGAGAGACGUUCAGCAACUUU | 1068 | AGUUGCUGAACGUCUCUCUUU | 2571 |
| D-2064 | 621-639 | 504-522 | GAGAGACGUUCAGCAACUUUU | 1069 | AAGUUGCUGAACGUCUCUCUU | 2572 |
| D-2065 | 622-640 | 505-523 | AGAGACGUUCAGCAACUUCUU | 1070 | GAAGUUGCUGAACGUCUCUUU | 2573 |
| D-2066 | 623-641 | 506-524 | GAGACGUUCAGCAACUUCAUU | 1071 | UGAAGUUGCUGAACGUCUCUU | 2574 |
| D-2067 | 6-24 | 6-24 | ACGGUGCACGGAAGAGUGAUU | 1072 | UCACUCUUCCGUGCACCGUUU | 2575 |
| D-2068 | 624-642 | 507-525 | AGACGUUCAGCAACUUCACUU | 1073 | GUGAAGUUGCUGAACGUCUUU | 2576 |
| D-2069 | 625-643 | 508-526 | GACGUUCAGCAACUUCACAUU | 1074 | UGUGAAGUUGCUGAACGUCUU | 2577 |
| D-2070 | 626-644 | 509-527 | ACGUUCAGCAACUUCACAGUU | 1075 | CUGUGAAGUUGCUGAACGUUU | 2578 |
| D-2071 | 627-645 | 510-528 | CGUUCAGCAACUUCACAGCUU | 1076 | GCUGUGAAGUUGCUGAACGUU | 2579 |
| D-2072 | 62-80 | 62-80 | CCUGGGGAGCAGAGCAGAGUU | 1077 | CUCUGCUCUGCUCCCCAGGUU | 2580 |
| D-2073 | 628-646 | 511-529 | GUUCAGCAACUUCACAGCGUU | 1078 | CGCUGUGAAGUUGCUGAACUU | 2581 |
| D-2074 | 629-647 | 512-530 | UUCAGCAACUUCACAGCGAUU | 1079 | UCGCUGUGAAGUUGCUGAAUU | 2582 |
| D-2075 | 630-648 | 513-531 | UCAGCAACUUCACAGCGAGUU | 1080 | CUCGCUGUGAAGUUGCUGAUU | 2583 |
| D-2076 | 631-649 | 514-532 | CAGCAACUUCACAGCGAGCUU | 1081 | GCUCGCUGUGAAGUUGCUGUU | 2584 |
| D-2077 | 632-650 | 515-533 | AGCAACUUCACAGCGAGCAUU | 1082 | UGCUCGCUGUGAAGUUGCUUU | 2585 |
| D-2078 | 633-651 | 516-534 | GCAACUUCACAGCGAGCACUU | 1083 | GUGCUCGCUGUGAAGUUGCUU | 2586 |
| D-2079 | 634-652 | 517-535 | CAACUUCACAGCGAGCACGUU | 1084 | CGUGCUCGCUGUGAAGUUGUU | 2587 |
| D-2080 | 635-653 | 518-536 | AACUUCACAGCGAGCACGGUU | 1085 | CCGUGCUCGCUGUGAAGUUUU | 2588 |
| D-2081 | 636-654 | 519-537 | ACUUCACAGCGAGCACGGAUU | 1086 | UCCGUGCUCGCUGUGAAGUUU | 2589 |
| D-2082 | 637-655 | 520-538 | CUUCACAGCGAGCACGGAGUU | 1087 | CUCCGUGCUCGCUGUGAAGUU | 2590 |
| D-2083 | 63-81 | 63-81 | CUGGGGAGCAGAGCAGAGGUU | 1088 | CCUCUGCUCUGCUCCCCAGUU | 2591 |
| D-2084 | 638-656 | 521-539 | UUCACAGCGAGCACGGAGGUU | 1089 | CCUCCGUGCUCGCUGUGAAUU | 2592 |
| D-2085 | 639-657 | 522-540 | UCACAGCGAGCACGGAGGCUU | 1090 | GCCUCCGUGCUCGCUGUGAUU | 2593 |
| D-2086 | 640-658 | 523-541 | CACAGCGAGCACGGAGGCCUU | 1091 | GGCCUCCGUGCUCGCUGUGUU | 2594 |
| D-2087 | 641-659 | 524-542 | ACAGCGAGCACGGAGGCCCUU | 1092 | GGGCCUCCGUGCUCGCUGUUU | 2595 |
| D-2088 | 642-660 | 525-543 | CAGCGAGCACGGAGGCCCAUU | 1093 | UGGGCCUCCGUGCUCGCUGUU | 2596 |
| D-2089 | 643-661 | 526-544 | AGCGAGCACGGAGGCCCAGUU | 1094 | CUGGGCCUCCGUGCUCGCUUU | 2597 |
| D-2090 | 644-662 | 527-545 | GCGAGCACGGAGGCCCAGGUU | 1095 | CCUGGGCCUCCGUGCUCGCUU | 2598 |
| D-2091 | 645-663 | 528-546 | CGAGCACGGAGGCCCAGGUUU | 1096 | ACCUGGGCCUCCGUGCUCGUU | 2599 |
| D-2092 | 646-664 | 529-547 | GAGCACGGAGGCCCAGGUCUU | 1097 | GACCUGGGCCUCCGUGCUCUU | 2600 |
| D-2093 | 647-665 | 530-548 | AGCACGGAGGCCCAGGUCAUU | 1098 | UGACCUGGGCCUCCGUGCUUU | 2601 |
| D-2094 | 64-82 | 64-82 | UGGGGAGCAGAGCAGAGGCUU | 1099 | GCCUCUGCUCUGCUCCCCAUU | 2602 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-2095 | 648-666 | 531-549 | GCACGGAGGCCCAGGUCAAUU | 1100 | UUGACCUGGGCCUCCGUGCUU | 2603 |
| D-2096 | 649-667 | 532-550 | CACGGAGGCCCAGGUCAAGUU | 1101 | CUUGACCUGGGCCUCCGUGUU | 2604 |
| D-2097 | 650-668 | 533-551 | ACGGAGGCCCAGGUCAAGGUU | 1102 | CCUUGACCUGGGCCUCCGUUU | 2605 |
| D-2098 | 651-669 | 534-552 | CGGAGGCCCAGGUCAAGGGUU | 1103 | CCCUUGACCUGGGCCUCCGUU | 2606 |
| D-2099 | 652-670 | 535-553 | GGAGGCCCAGGUCAAGGGCUU | 1104 | GCCCUUGACCUGGGCCUCCUU | 2607 |
| D-2100 | 653-671 | 536-554 | GAGGCCCAGGUCAAGGGCUUU | 1105 | AGCCCUUGACCUGGGCCUCUU | 2608 |
| D-2101 | 654-672 | 537-555 | AGGCCCAGGUCAAGGGCUUUU | 1106 | AAGCCCUUGACCUGGGCCUUU | 2609 |
| D-2102 | 655-673 | 538-556 | GGCCCAGGUCAAGGGCUUGUU | 1107 | CAAGCCCUUGACCUGGGCCUU | 2610 |
| D-2103 | 656-674 | 539-557 | GCCCAGGUCAAGGGCUUGAUU | 1108 | UCAAGCCCUUGACCUGGGCUU | 2611 |
| D-2104 | 657-675 | 540-558 | CCCAGGUCAAGGGCUUGAGUU | 1109 | CUCAAGCCCUUGACCUGGGUU | 2612 |
| D-2105 | 65-83 | 65-83 | GGGGAGCAGAGCAGAGGCAUU | 1110 | UGCCUCUGCUCUGCUCCCCUU | 2613 |
| D-2106 | 658-676 | 541-559 | CCAGGUCAAGGGCUUGAGCUU | 1111 | GCUCAAGCCCUUGACCUGGUU | 2614 |
| D-2107 | 659-677 | 542-560 | CAGGUCAAGGGCUUGAGCAUU | 1112 | UGCUCAAGCCCUUGACCUGUU | 2615 |
| D-2108 | 660-678 | 543-561 | AGGUCAAGGGCUUGAGCACUU | 1113 | GUGCUCAAGCCCUUGACCUUU | 2616 |
| D-2109 | 661-679 | 544-562 | GGUCAAGGGCUUGAGCACCUU | 1114 | GGUGCUCAAGCCCUUGACCUU | 2617 |
| D-2110 | 662-680 | 545-563 | GUCAAGGGCUUGAGCACCCUU | 1115 | GGGUGCUCAAGCCCUUGACUU | 2618 |
| D-2111 | 663-681 | 546-564 | UCAAGGGCUUGAGCACCCAUU | 1116 | UGGGUGCUCAAGCCCUUGAUU | 2619 |
| D-2112 | 664-682 | 547-565 | CAAGGGCUUGAGCACCCAGUU | 1117 | CUGGGUGCUCAAGCCCUUGUU | 2620 |
| D-2113 | 665-683 | 548-566 | AAGGGCUUGAGCACCCAGGUU | 1118 | CCUGGGUGCUCAAGCCCUUUU | 2621 |
| D-2114 | 666-684 | 549-567 | AGGGCUUGAGCACCCAGGGUU | 1119 | CCCUGGGUGCUCAAGCCCUUU | 2622 |
| D-2115 | 667-685 | 550-568 | GGGCUUGAGCACCCAGGGAUU | 1120 | UCCCUGGGUGCUCAAGCCCUU | 2623 |
| D-2116 | 66-84 | 66-84 | GGGAGCAGAGCAGAGGCAAUU | 1121 | UUGCCUCUGCUCUGCUCCCUU | 2624 |
| D-2117 | 668-686 | 551-569 | GGCUUGAGCACCCAGGGAGUU | 1122 | CUCCCUGGGUGCUCAAGCCUU | 2625 |
| D-2118 | 669-687 | 552-570 | GCUUGAGCACCCAGGGAGGUU | 1123 | CCUCCCUGGGUGCUCAAGCUU | 2626 |
| D-2119 | 670-688 | 553-571 | CUUGAGCACCCAGGGAGGCUU | 1124 | GCCUCCCUGGGUGCUCAAGUU | 2627 |
| D-2120 | 671-689 | 554-572 | UUGAGCACCCAGGGAGGCAUU | 1125 | UGCCUCCCUGGGUGCUCAAUU | 2628 |
| D-2121 | 672-690 | 555-573 | UGAGCACCCAGGGAGGCAAUU | 1126 | UUGCCUCCCUGGGUGCUCAUU | 2629 |
| D-2122 | 673-691 | 556-574 | GAGCACCCAGGGAGGCAAUUU | 1127 | AUUGCCUCCCUGGGUGCUCUU | 2630 |
| D-2123 | 674-692 | 557-575 | AGCACCCAGGGAGGCAAUGUU | 1128 | CAUUGCCUCCCUGGGUGCUUU | 2631 |
| D-2124 | 675-693 | 558-576 | GCACCCAGGGAGGCAAUGUUU | 1129 | ACAUUGCCUCCCUGGGUGCUU | 2632 |
| D-2125 | 676-694 | 559-577 | CACCCAGGGAGGCAAUGUGUU | 1130 | CACAUUGCCUCCCUGGGUGUU | 2633 |
| D-2126 | 677-695 | 560-578 | ACCCAGGGAGGCAAUGUGGUU | 1131 | CCACAUUGCCUCCCUGGGUUU | 2634 |
| D-2127 | 67-85 | 67-85 | GGAGCAGAGCAGAGGCAACUU | 1132 | GUUGCCUCUGCUCUGCUCCUU | 2635 |
| D-2128 | 678-696 | 561-579 | CCCAGGGAGGCAAUGUGGGUU | 1133 | CCCACAUUGCCUCCCUGGGUU | 2636 |
| D-2129 | 679-697 | 562-580 | CCAGGGAGGCAAUGUGGGAUU | 1134 | UCCCACAUUGCCUCCCUGGUU | 2637 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-2130 | 680-698 | 563-581 | CAGGGAGGCAAUGUGGGAAUU | 1135 | UUCCCACAUUGCCUCCCUGUU | 2638 |
| D-2131 | 681-699 | 564-582 | AGGGAGGCAAUGUGGGAAGUU | 1136 | CUUCCCACAUUGCCUCCCUUU | 2639 |
| D-2132 | 682-700 | 565-583 | GGGAGGCAAUGUGGGAAGAUU | 1137 | UCUUCCCACAUUGCCUCCCUU | 2640 |
| D-2133 | 683-701 | 566-584 | GGAGGCAAUGUGGGAAGAAUU | 1138 | UUCUUCCCACAUUGCCUCCUU | 2641 |
| D-2134 | 684-702 | 567-585 | GAGGCAAUGUGGGAAGAAAUU | 1139 | UUUCUUCCCACAUUGCCUCUU | 2642 |
| D-2135 | 685-703 | 568-586 | AGGCAAUGUGGGAAGAAAGUU | 1140 | CUUUCUUCCCACAUUGCCUUU | 2643 |
| D-2136 | 686-704 | 569-587 | GGCAAUGUGGGAAGAAAGAUU | 1141 | UCUUUCUUCCCACAUUGCCUU | 2644 |
| D-2137 | 687-705 | 570-588 | GCAAUGUGGGAAGAAAGAUUU | 1142 | AUCUUUCUUCCCACAUUGCUU | 2645 |
| D-2138 | 68-86 | 68-86 | GAGCAGAGCAGAGGCAACCUU | 1143 | GGUUGCCUCUGCUCUGCUCUU | 2646 |
| D-2139 | 688-706 | 571-589 | CAAUGUGGGAAGAAAGAUGUU | 1144 | CAUCUUUCUUCCCACAUUGUU | 2647 |
| D-2140 | 689-707 | 572-590 | AAUGUGGGAAGAAAGAUGAUU | 1145 | UCAUCUUUCUUCCCACAUUUU | 2648 |
| D-2141 | 690-708 | 573-591 | AUGUGGGAAGAAAGAUGAAUU | 1146 | UUCAUCUUUCUUCCCACAUUU | 2649 |
| D-2142 | 691-709 | 574-592 | UGUGGGAAGAAAGAUGAAGUU | 1147 | CUUCAUCUUUCUUCCCACAUU | 2650 |
| D-2143 | 692-710 | 575-593 | GUGGGAAGAAAGAUGAAGUUU | 1148 | ACUUCAUCUUUCUUCCCACUU | 2651 |
| D-2144 | 693-711 | 576-594 | UGGGAAGAAAGAUGAAGUCUU | 1149 | GACUUCAUCUUUCUUCCCAUU | 2652 |
| D-2145 | 694-712 | 577-595 | GGGAAGAAAGAUGAAGUCGUU | 1150 | CGACUUCAUCUUUCUUCCCUU | 2653 |
| D-2146 | 695-713 | 578-596 | GGAAGAAAGAUGAAGUCGCUU | 1151 | GCGACUUCAUCUUUCUUCCUU | 2654 |
| D-2147 | 696-714 | 579-597 | GAAGAAAGAUGAAGUCGCUUU | 1152 | AGCGACUUCAUCUUUCUUCUU | 2655 |
| D-2148 | 697-715 | 580-598 | AAGAAAGAUGAAGUCGCUAUU | 1153 | UAGCGACUUCAUCUUUCUUUU | 2656 |
| D-2149 | 69-87 | 69-87 | AGCAGAGCAGAGGCAACCCUU | 1154 | GGGUUGCCUCUGCUCUGCUUU | 2657 |
| D-2150 | 698-716 | 581-599 | AGAAAGAUGAAGUCGCUAGUU | 1155 | CUAGCGACUUCAUCUUUCUUU | 2658 |
| D-2151 | 699-717 | 581-600 | GAAAGAUGAAGUCGCUAGAUU | 1156 | UCUAGCGACUUCAUCUUUCUU | 2659 |
| D-2152 | 700-718 | 581-601 | AAAGAUGAAGUCGCUAGAGUU | 1157 | CUCUAGCGACUUCAUCUUUUU | 2660 |
| D-2153 | 701-719 | 581-602 | AAGAUGAAGUCGCUAGAGUUU | 1158 | ACUCUAGCGACUUCAUCUUUU | 2661 |
| D-2154 | 702-720 | 581-603 | AGAUGAAGUCGCUAGAGUCUU | 1159 | GACUCUAGCGACUUCAUCUUU | 2662 |
| D-2155 | 703-721 | 581-604 | GAUGAAGUCGCUAGAGUCCUU | 1160 | GGACUCUAGCGACUUCAUCUU | 2663 |
| D-2156 | 704-722 | 581-605 | AUGAAGUCGCUAGAGUCCCUU | 1161 | GGGACUCUAGCGACUUCAUUU | 2664 |
| D-2157 | 705-723 | 581-606 | UGAAGUCGCUAGAGUCCCAUU | 1162 | UGGGACUCUAGCGACUUCAUU | 2665 |
| D-2158 | 706-724 | 581-607 | GAAGUCGCUAGAGUCCCAGUU | 1163 | CUGGGACUCUAGCGACUUCUU | 2666 |
| D-2159 | 707-725 | 581-608 | AAGUCGCUAGAGUCCCAGCUU | 1164 | GCUGGGACUCUAGCGACUUUU | 2667 |
| D-2160 | 708-726 | 581-609 | AGUCGCUAGAGUCCCAGCUUU | 1165 | AGCUGGGACUCUAGCGACUUU | 2668 |
| D-2161 | 70-88 | 70-88 | GCAGAGCAGAGGCAACCCAUU | 1166 | UGGGUUGCCUCUGCUCUGCUU | 2669 |
| D-2162 | 709-727 | 592-610 | GUCGCUAGAGUCCCAGCUGUU | 1167 | CAGCUGGGACUCUAGCGACUU | 2670 |
| D-2163 | 710-728 | 593-611 | UCGCUAGAGUCCCAGCUGGUU | 1168 | CCAGCUGGGACUCUAGCGAUU | 2671 |
| D-2164 | 711-729 | 594-612 | CGCUAGAGUCCCAGCUGGAUU | 1169 | UCCAGCUGGGACUCUAGCGUU | 2672 |
| D-2165 | 712-730 | 595-613 | GCUAGAGUCCCAGCUGGAGUU | 1170 | CUCCAGCUGGGACUCUAGCUU | 2673 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-2166 | 713-731 | 596-614 | CUAGAGUCCCAGCUGGAGAUU | 1171 | UCUCCAGCUGGGACUCUAGUU | 2674 |
| D-2167 | 714-732 | 597-615 | UAGAGUCCCAGCUGGAGAAUU | 1172 | UUCUCCAGCUGGGACUCUAUU | 2675 |
| D-2168 | 715-733 | 598-616 | AGAGUCCCAGCUGGAGAAAUU | 1173 | UUUCUCCAGCUGGGACUCUUU | 2676 |
| D-2169 | 716-734 | 599-617 | GAGUCCCAGCUGGAGAAACUU | 1174 | GUUUCUCCAGCUGGGACUCUU | 2677 |
| D-2170 | 717-735 | 600-618 | AGUCCCAGCUGGAGAAACAUU | 1175 | UGUUUCUCCAGCUGGGACUUU | 2678 |
| D-2171 | 718-736 | 601-619 | GUCCCAGCUGGAGAAACAGUU | 1176 | CUGUUUCUCCAGCUGGGACUU | 2679 |
| D-2172 | 71-89 | 71-89 | CAGAGCAGAGGCAACCCAUUU | 1177 | AUGGGUUGCCUCUGCUCUGUU | 2680 |
| D-2173 | 719-737 | 602-620 | UCCCAGCUGGAGAAACAGCUU | 1178 | GCUGUUUCUCCAGCUGGGAUU | 2681 |
| D-2174 | 720-738 | 603-621 | CCCAGCUGGAGAAACAGCAUU | 1179 | UGCUGUUUCUCCAGCUGGGUU | 2682 |
| D-2175 | 721-739 | 604-622 | CCAGCUGGAGAAACAGCAGUU | 1180 | CUGCUGUUUCUCCAGCUGGUU | 2683 |
| D-2176 | 722-740 | 605-623 | CAGCUGGAGAAACAGCAGAUU | 1181 | UCUGCUGUUUCUCCAGCUGUU | 2684 |
| D-2177 | 723-741 | 606-624 | AGCUGGAGAAACAGCAGAAUU | 1182 | UUCUGCUGUUUCUCCAGCUUU | 2685 |
| D-2178 | 724-742 | 607-625 | GCUGGAGAAACAGCAGAAGUU | 1183 | CUUCUGCUGUUUCUCCAGCUU | 2686 |
| D-2179 | 7-25 | 7-25 | CGGUGCACGGAAGAGUGAGUU | 1184 | CUCACUCUUCCGUGCACCGUU | 2687 |
| D-2180 | 725-743 | 608-626 | CUGGAGAAACAGCAGAAGGUU | 1185 | CCUUCUGCUGUUUCUCCAGUU | 2688 |
| D-2181 | 726-744 | 609-627 | UGGAGAAACAGCAGAAGGAUU | 1186 | UCCUUCUGCUGUUUCUCCAUU | 2689 |
| D-2182 | 727-745 | 610-628 | GGAGAAACAGCAGAAGGACUU | 1187 | GUCCUUCUGCUGUUUCUCCUU | 2690 |
| D-2183 | 728-746 | 611-629 | GAGAAACAGCAGAAGGACCUU | 1188 | GGUCCUUCUGCUGUUUCUCUU | 2691 |
| D-2184 | 72-90 | 72-90 | AGAGCAGAGGCAACCCAUCUU | 1189 | GAUGGGUUGCCUCUGCUCUUU | 2692 |
| D-2185 | 729-747 | 612-630 | AGAAACAGCAGAAGGACCUUU | 1190 | AGGUCCUUCUGCUGUUUCUUU | 2693 |
| D-2186 | 730-748 | 613-631 | GAAACAGCAGAAGGACCUGUU | 1191 | CAGGUCCUUCUGCUGUUUCUU | 2694 |
| D-2187 | 731-749 | 614-632 | AAACAGCAGAAGGACCUGAUU | 1192 | UCAGGUCCUUCUGCUGUUUUU | 2695 |
| D-2188 | 732-750 | 615-633 | AACAGCAGAAGGACCUGAGUU | 1193 | CUCAGGUCCUUCUGCUGUUUU | 2696 |
| D-2189 | 733-751 | 616-634 | ACAGCAGAAGGACCUGAGUUU | 1194 | ACUCAGGUCCUUCUGCUGUUU | 2697 |
| D-2190 | 734-752 | 617-635 | CAGCAGAAGGACCUGAGUGUU | 1195 | CACUCAGGUCCUUCUGCUGUU | 2698 |
| D-2191 | 735-753 | 618-636 | AGCAGAAGGACCUGAGUGAUU | 1196 | UCACUCAGGUCCUUCUGCUUU | 2699 |
| D-2192 | 736-754 | 619-637 | GCAGAAGGACCUGAGUGAAUU | 1197 | UUCACUCAGGUCCUUCUGCUU | 2700 |
| D-2193 | 737-755 | 620-638 | CAGAAGGACCUGAGUGAAGUU | 1198 | CUUCACUCAGGUCCUUCUGUU | 2701 |
| D-2194 | 738-756 | 621-639 | AGAAGGACCUGAGUGAAGAUU | 1199 | UCUUCACUCAGGUCCUUCUUU | 2702 |
| D-2195 | 73-91 | 73-91 | GAGCAGAGGCAACCCAUCCUU | 1200 | GGAUGGGUUGCCUCUGCUCUU | 2703 |
| D-2196 | 739-757 | 622-640 | GAAGGACCUGAGUGAAGAUUU | 1201 | AUCUUCACUCAGGUCCUUCUU | 2704 |
| D-2197 | 740-758 | 623-641 | AAGGACCUGAGUGAAGAUCUU | 1202 | GAUCUUCACUCAGGUCCUUUU | 2705 |
| D-2198 | 741-759 | 624-642 | AGGACCUGAGUGAAGAUCAUU | 1203 | UGAUCUUCACUCAGGUCCUUU | 2706 |
| D-2199 | 742-760 | 625-643 | GGACCUGAGUGAAGAUCACUU | 1204 | GUGAUCUUCACUCAGGUCCUU | 2707 |
| D-2200 | 743-761 | 626-644 | GACCUGAGUGAAGAUCACUUU | 1205 | AGUGAUCUUCACUCAGGUCUU | 2708 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-2201 | 744-762 | 627-645 | ACCUGAGUGAAGAUCACUCUU | 1206 | GAGUGAUCUUCACUCAGGUUU | 2709 |
| D-2202 | 745-763 | 628-646 | CCUGAGUGAAGAUCACUCCUU | 1207 | GGAGUGAUCUUCACUCAGGUU | 2710 |
| D-2203 | 746-764 | 629-647 | CUGAGUGAAGAUCACUCCAUU | 1208 | UGGAGUGAUCUUCACUCAGUU | 2711 |
| D-2204 | 747-765 | 630-648 | UGAGUGAAGAUCACUCCAGUU | 1209 | CUGGAGUGAUCUUCACUCAUU | 2712 |
| D-2205 | 748-766 | 631-649 | GAGUGAAGAUCACUCCAGCUU | 1210 | GCUGGAGUGAUCUUCACUCUU | 2713 |
| D-2206 | 74-92 | 74-92 | AGCAGAGGCAACCCAUCCCUU | 1211 | GGGAUGGGUUGCCUCUGCUUU | 2714 |
| D-2207 | 749-767 | 632-650 | AGUGAAGAUCACUCCAGCCUU | 1212 | GGCUGGAGUGAUCUUCACUUU | 2715 |
| D-2208 | 750-768 | 633-651 | GUGAAGAUCACUCCAGCCUUU | 1213 | AGGCUGGAGUGAUCUUCACUU | 2716 |
| D-2209 | 751-769 | 634-652 | UGAAGAUCACUCCAGCCUGUU | 1214 | CAGGCUGGAGUGAUCUUCAUU | 2717 |
| D-2210 | 752-770 | 635-653 | GAAGAUCACUCCAGCCUGCUU | 1215 | GCAGGCUGGAGUGAUCUUCUU | 2718 |
| D-2211 | 753-771 | 636-654 | AAGAUCACUCCAGCCUGCUUU | 1216 | AGCAGGCUGGAGUGAUCUUUU | 2719 |
| D-2212 | 754-772 | 637-655 | AGAUCACUCCAGCCUGCUGUU | 1217 | CAGCAGGCUGGAGUGAUCUUU | 2720 |
| D-2213 | 755-773 | 638-656 | GAUCACUCCAGCCUGCUGCUU | 1218 | GCAGCAGGCUGGAGUGAUCUU | 2721 |
| D-2214 | 756-774 | 639-657 | AUCACUCCAGCCUGCUGCUUU | 1219 | AGCAGCAGGCUGGAGUGAUUU | 2722 |
| D-2215 | 757-775 | 640-658 | UCACUCCAGCCUGCUGCUCUU | 1220 | GAGCAGCAGGCUGGAGUGAUU | 2723 |
| D-2216 | 758-776 | 641-659 | CACUCCAGCCUGCUGCUCCUU | 1221 | GGAGCAGCAGGCUGGAGUGUU | 2724 |
| D-2217 | 75-93 | 75-93 | GCAGAGGCAACCCAUCCCCUU | 1222 | GGGGAUGGGUUGCCUCUGCUU | 2725 |
| D-2218 | 759-777 | 642-660 | ACUCCAGCCUGCUGCUCCAUU | 1223 | UGGAGCAGCAGGCUGGAGUUU | 2726 |
| D-2219 | 760-778 | 643-661 | CUCCAGCCUGCUGCUCCACUU | 1224 | GUGGAGCAGCAGGCUGGAGUU | 2727 |
| D-2220 | 761-779 | 644-662 | UCCAGCCUGCUGCUCCACGUU | 1225 | CGUGGAGCAGCAGGCUGGAUU | 2728 |
| D-2221 | 762-780 | 645-663 | CCAGCCUGCUGCUCCACGUUU | 1226 | ACGUGGAGCAGCAGGCUGGUU | 2729 |
| D-2222 | 763-781 | 646-664 | CAGCCUGCUGCUCCACGUGUU | 1227 | CACGUGGAGCAGCAGGCUGUU | 2730 |
| D-2223 | 764-782 | 647-665 | AGCCUGCUGCUCCACGUGAUU | 1228 | UCACGUGGAGCAGCAGGCUUU | 2731 |
| D-2224 | 765-783 | 648-666 | GCCUGCUGCUCCACGUGAAUU | 1229 | UUCACGUGGAGCAGCAGGCUU | 2732 |
| D-2225 | 766-784 | 649-667 | CCUGCUGCUCCACGUGAAGUU | 1230 | CUUCACGUGGAGCAGCAGGUU | 2733 |
| D-2226 | 767-785 | 650-668 | CUGCUGCUCCACGUGAAGCUU | 1231 | GCUUCACGUGGAGCAGCAGUU | 2734 |
| D-2227 | 768-786 | 651-669 | UGCUGCUCCACGUGAAGCAUU | 1232 | UGCUUCACGUGGAGCAGCAUU | 2735 |
| D-2228 | 76-94 | 76-94 | CAGAGGCAACCCAUCCCCUU | 1233 | GGGGGAUGGGUUGCCUCUGUU | 2736 |
| D-2229 | 769-787 | 652-670 | GCUGCUCCACGUGAAGCAGUU | 1234 | CUGCUUCACGUGGAGCAGCUU | 2737 |
| D-2230 | 770-788 | 653-671 | CUGCUCCACGUGAAGCAGUUU | 1235 | ACUGCUUCACGUGGAGCAGUU | 2738 |
| D-2231 | 771-789 | 654-672 | UGCUCCACGUGAAGCAGUUUU | 1236 | AACUGCUUCACGUGGAGCAUU | 2739 |
| D-2232 | 772-790 | 655-673 | GCUCCACGUGAAGCAGUUCUU | 1237 | GAACUGCUUCACGUGGAGCUU | 2740 |
| D-2233 | 773-791 | 656-674 | CUCCACGUGAAGCAGUUCGUU | 1238 | CGAACUGCUUCACGUGGAGUU | 2741 |
| D-2234 | 774-792 | 657-675 | UCCACGUGAAGCAGUUCGUUU | 1239 | ACGAACUGCUUCACGUGGAUU | 2742 |
| D-2235 | 775-793 | 658-676 | CCACGUGAAGCAGUUCGUGUU | 1240 | CACGAACUGCUUCACGUGGUU | 2743 |
| D-2236 | 776-794 | 659-677 | CACGUGAAGCAGUUCGUGUUU | 1241 | ACACGAACUGCUUCACGUGUU | 2744 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-2237 | 777-795 | 660-678 | ACGUGAAGCAGUUCGUGUCUUU | 1242 | GACACGAACUGCUUCACGUUU | 2745 |
| D-2238 | 778-796 | 661-679 | CGUGAAGCAGUUCGUGUCUUUU | 1243 | AGACACGAACUGCUUCACGUU | 2746 |
| D-2239 | 77-95 | 77-95 | AGAGGCAACCCAUCCCCCAUU | 1244 | UGGGGGAUGGGUUGCCUCUUU | 2747 |
| D-2240 | 779-797 | 662-680 | GUGAAGCAGUUCGUGUCUGUU | 1245 | CAGACACGAACUGCUUCACUU | 2748 |
| D-2241 | 780-798 | 663-681 | UGAAGCAGUUCGUGUCUGAUU | 1246 | UCAGACACGAACUGCUUCAUU | 2749 |
| D-2242 | 781-799 | 664-682 | GAAGCAGUUCGUGUCUGACUU | 1247 | GUCAGACACGAACUGCUUCUU | 2750 |
| D-2243 | 782-800 | 665-683 | AAGCAGUUCGUGUCUGACCUU | 1248 | GGUCAGACACGAACUGCUUUU | 2751 |
| D-2244 | 783-801 | 666-684 | AGCAGUUCGUGUCUGACCUUU | 1249 | AGGUCAGACACGAACUGCUUU | 2752 |
| D-2245 | 784-802 | 667-685 | GCAGUUCGUGUCUGACCUGUU | 1250 | CAGGUCAGACACGAACUGCUU | 2753 |
| D-2246 | 785-803 | 668-686 | CAGUUCGUGUCUGACCUGCUU | 1251 | GCAGGUCAGACACGAACUGUU | 2754 |
| D-2247 | 786-804 | 669-687 | AGUUCGUGUCUGACCUGCGUU | 1252 | CGCAGGUCAGACACGAACUUU | 2755 |
| D-2248 | 787-805 | 670-688 | GUUCGUGUCUGACCUGCGGUU | 1253 | CCGCAGGUCAGACACGAACUU | 2756 |
| D-2249 | 788-806 | 671-689 | UUCGUGUCUGACCUGCGGAUU | 1254 | UCCGCAGGUCAGACACGAAUU | 2757 |
| D-2250 | 78-96 | 78-96 | GAGGCAACCCAUCCCCCACUU | 1255 | GUGGGGGAUGGGUUGCCUCUU | 2758 |
| D-2251 | 789-807 | 672-690 | UCGUGUCUGACCUGCGGAGUU | 1256 | CUCCGCAGGUCAGACACGAUU | 2759 |
| D-2252 | 790-808 | 673-691 | CGUGUCUGACCUGCGGAGCUU | 1257 | GCUCCGCAGGUCAGACACGUU | 2760 |
| D-2253 | 791-809 | 674-692 | GUGUCUGACCUGCGGAGCCUU | 1258 | GGCUCCGCAGGUCAGACACUU | 2761 |
| D-2254 | 792-810 | 675-693 | UGUCUGACCUGCGGAGCCUUU | 1259 | AGGCUCCGCAGGUCAGACAUU | 2762 |
| D-2255 | 793-811 | 676-694 | GUCUGACCUGCGGAGCCUGUU | 1260 | CAGGCUCCGCAGGUCAGACUU | 2763 |
| D-2256 | 794-812 | 677-695 | UCUGACCUGCGGAGCCUGAUU | 1261 | UCAGGCUCCGCAGGUCAGAUU | 2764 |
| D-2257 | 795-813 | 678-696 | CUGACCUGCGGAGCCUGAGUU | 1262 | CUCAGGCUCCGCAGGUCAGUU | 2765 |
| D-2258 | 796-814 | 679-697 | UGACCUGCGGAGCCUGAGCUU | 1263 | GCUCAGGCUCCGCAGGUCAUU | 2766 |
| D-2259 | 797-815 | 680-698 | GACCUGCGGAGCCUGAGCUUU | 1264 | AGCUCAGGCUCCGCAGGUCUU | 2767 |
| D-2260 | 798-816 | 681-699 | ACCUGCGGAGCCUGAGCUGUU | 1265 | CAGCUCAGGCUCCGCAGGUUU | 2768 |
| D-2261 | 79-97 | 79-97 | AGGCAACCCAUCCCCCACUUU | 1266 | AGUGGGGGAUGGGUUGCCUUU | 2769 |
| D-2262 | 799-817 | 682-700 | CCUGCGGAGCCUGAGCUGUUU | 1267 | ACAGCUCAGGCUCCGCAGGUU | 2770 |
| D-2263 | 800-818 | 683-701 | CUGCGGAGCCUGAGCUGUCUU | 1268 | GACAGCUCAGGCUCCGCAGUU | 2771 |
| D-2264 | 801-819 | 684-702 | UGCGGAGCCUGAGCUGUCAUU | 1269 | UGACAGCUCAGGCUCCGCAUU | 2772 |
| D-2265 | 802-820 | 685-703 | GCGGAGCCUGAGCUGUCAGUU | 1270 | CUGACAGCUCAGGCUCCGCUU | 2773 |
| D-2266 | 803-821 | 686-704 | CGGAGCCUGAGCUGUCAGAUU | 1271 | UCUGACAGCUCAGGCUCCGUU | 2774 |
| D-2267 | 804-822 | 687-705 | GGAGCCUGAGCUGUCAGAUUU | 1272 | AUCUGACAGCUCAGGCUCCUU | 2775 |
| D-2268 | 805-823 | 688-706 | GAGCCUGAGCUGUCAGAUGUU | 1273 | CAUCUGACAGCUCAGGCUCUU | 2776 |
| D-2269 | 806-824 | 689-707 | AGCCUGAGCUGUCAGAUGGUU | 1274 | CCAUCUGACAGCUCAGGCUUU | 2777 |
| D-2270 | 807-825 | 690-708 | GCCUGAGCUGUCAGAUGGCUU | 1275 | GCCAUCUGACAGCUCAGGCUU | 2778 |
| D-2271 | 808-826 | 691-709 | CCUGAGCUGUCAGAUGGCGUU | 1276 | CGCCAUCUGACAGCUCAGGUU | 2779 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-2272 | 80-98 | 80-98 | GGCAACCCAUCCCCCACUCUU | 1277 | GAGUGGGGGAUGGGUUGCCUU | 2780 |
| D-2273 | 809-827 | 692-710 | CUGAGCUGUCAGAUGGCGGUU | 1278 | CCGCCAUCUGACAGCUCAGUU | 2781 |
| D-2274 | 810-828 | 693-711 | UGAGCUGUCAGAUGGCGGCUU | 1279 | GCCGCCAUCUGACAGCUCAUU | 2782 |
| D-2275 | 811-829 | 694-712 | GAGCUGUCAGAUGGCGGCGUU | 1280 | CGCCGCCAUCUGACAGCUCUU | 2783 |
| D-2276 | 812-830 | 695-713 | AGCUGUCAGAUGGCGGCGCUU | 1281 | GCGCCGCCAUCUGACAGCUUU | 2784 |
| D-2277 | 813-831 | 696-714 | GCUGUCAGAUGGCGGCGCUUU | 1282 | AGCGCCGCCAUCUGACAGCUU | 2785 |
| D-2278 | 814-832 | 697-715 | CUGUCAGAUGGCGGCGCUCUU | 1283 | GAGCGCCGCCAUCUGACAGUU | 2786 |
| D-2279 | 815-833 | 698-716 | UGUCAGAUGGCGGCGCUCCUU | 1284 | GGAGCGCCGCCAUCUGACAUU | 2787 |
| D-2280 | 816-834 | 699-717 | GUCAGAUGGCGGCGCUCCAUU | 1285 | UGGAGCGCCGCCAUCUGACUU | 2788 |
| D-2281 | 817-835 | 700-718 | UCAGAUGGCGGCGCUCCAGUU | 1286 | CUGGAGCGCCGCCAUCUGAUU | 2789 |
| D-2282 | 818-836 | 701-719 | CAGAUGGCGGCGCUCCAGGUU | 1287 | CCUGGAGCGCCGCCAUCUGUU | 2790 |
| D-2283 | 819-837 | 702-720 | AGAUGGCGGCGCUCCAGGGUU | 1288 | CCCUGGAGCGCCGCCAUCUUU | 2791 |
| D-2284 | 81-99 | 81-99 | GCAACCCAUCCCCCACUCCUU | 1289 | GGAGUGGGGGAUGGGUUGCUU | 2792 |
| D-2285 | 820-838 | 703-721 | GAUGGCGGCGCUCCAGGGCUU | 1290 | GCCCUGGAGCGCCGCCAUCUU | 2793 |
| D-2286 | 82-100 | 82-100 | CAACCCAUCCCCCACUCCCUU | 1291 | GGGAGUGGGGGAUGGGUUGUU | 2794 |
| D-2287 | 821-839 | 704-722 | AUGGCGGCGCUCCAGGGCAUU | 1292 | UGCCCUGGAGCGCCGCCAUUU | 2795 |
| D-2288 | 822-840 | 705-723 | UGGCGGCGCUCCAGGGCAAUU | 1293 | UUGCCCUGGAGCGCCGCCAUU | 2796 |
| D-2289 | 823-841 | 706-724 | GGCGGCGCUCCAGGGCAAUUU | 1294 | AUUGCCCUGGAGCGCCGCCUU | 2797 |
| D-2290 | 824-842 | 707-725 | GCGGCGCUCCAGGGCAAUGUU | 1295 | CAUUGCCCUGGAGCGCCGCUU | 2798 |
| D-2291 | 825-843 | 708-726 | CGGCGCUCCAGGGCAAUGGUU | 1296 | CCAUUGCCCUGGAGCGCCGUU | 2799 |
| D-2292 | 8-26 | 8-26 | GGUGCACGGAAGAGUGAGGUU | 1297 | CCUCACUCUUCCGUGCACCUU | 2800 |
| D-2293 | 826-844 | 709-727 | GGCGCUCCAGGGCAAUGGCUU | 1298 | GCCAUUGCCCUGGAGCGCCUU | 2801 |
| D-2294 | 827-845 | 710-728 | GCGCUCCAGGGCAAUGGCUUU | 1299 | AGCCAUUGCCCUGGAGCGCUU | 2802 |
| D-2295 | 828-846 | 711-729 | CGCUCCAGGGCAAUGGCUCUU | 1300 | GAGCCAUUGCCCUGGAGCGUU | 2803 |
| D-2296 | 829-847 | 712-730 | GCUCCAGGGCAAUGGCUCAUU | 1301 | UGAGCCAUUGCCCUGGAGCUU | 2804 |
| D-2297 | 830-848 | 713-731 | CUCCAGGGCAAUGGCUCAGUU | 1302 | CUGAGCCAUUGCCCUGGAGUU | 2805 |
| D-2298 | 83-101 | 83-101 | AACCCAUCCCCCACUCCCAUU | 1303 | UGGGAGUGGGGGAUGGGUUUU | 2806 |
| D-2299 | 831-849 | 714-732 | UCCAGGGCAAUGGCUCAGAUU | 1304 | UCUGAGCCAUUGCCCUGGAUU | 2807 |
| D-2300 | 832-850 | 715-733 | CCAGGGCAAUGGCUCAGAAUU | 1305 | UUCUGAGCCAUUGCCCUGGUU | 2808 |
| D-2301 | 833-851 | 716-734 | CAGGGCAAUGGCUCAGAAAUU | 1306 | UUUCUGAGCCAUUGCCCUGUU | 2809 |
| D-2302 | 834-852 | 717-735 | AGGGCAAUGGCUCAGAAAGUU | 1307 | CUUUCUGAGCCAUUGCCCUUU | 2810 |
| D-2303 | 835-853 | 718-736 | GGGCAAUGGCUCAGAAAGGUU | 1308 | CCUUUCUGAGCCAUUGCCCUU | 2811 |
| D-2304 | 836-854 | 719-737 | GGCAAUGGCUCAGAAAGGAUU | 1309 | UCCUUUCUGAGCCAUUGCCUU | 2812 |
| D-2305 | 837-855 | 720-738 | GCAAUGGCUCAGAAAGGACUU | 1310 | GUCCUUUCUGAGCCAUUGCUU | 2813 |
| D-2306 | 838-856 | 721-739 | CAAUGGCUCAGAAAGGACCUU | 1311 | GGUCCUUUCUGAGCCAUUGUU | 2814 |
| D-2307 | 839-857 | 722-740 | AAUGGCUCAGAAAGGACCUUU | 1312 | AGGUCCUUUCUGAGCCAUUUU | 2815 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-2308 | 840-858 | 723-741 | AUGGCUCAGAAAGGACCUGUU | 1313 | CAGGUCCUUUCUGAGCCAUUU | 2816 |
| D-2309 | 84-102 | 84-102 | ACCCAUCCCCCACUCCCACUU | 1314 | GUGGGAGUGGGGGAUGGGUUU | 2817 |
| D-2310 | 841-859 | 724-742 | UGGCUCAGAAAGGACCUGCUU | 1315 | GCAGGUCCUUUCUGAGCCAUU | 2818 |
| D-2311 | 842-860 | 725-743 | GGCUCAGAAAGGACCUGCUUU | 1316 | AGCAGGUCCUUUCUGAGCCUU | 2819 |
| D-2312 | 843-861 | 726-744 | GCUCAGAAAGGACCUGCUGUU | 1317 | CAGCAGGUCCUUUCUGAGCUU | 2820 |
| D-2313 | 844-862 | 727-745 | CUCAGAAAGGACCUGCUGCUU | 1318 | GCAGCAGGUCCUUUCUGAGUU | 2821 |
| D-2314 | 845-863 | 728-746 | UCAGAAAGGACCUGCUGCCUU | 1319 | GGCAGCAGGUCCUUUCUGAUU | 2822 |
| D-2315 | 846-864 | 729-747 | CAGAAAGGACCUGCUGCCCUU | 1320 | GGGCAGCAGGUCCUUUCUGUU | 2823 |
| D-2316 | 847-865 | 730-748 | AGAAAGGACCUGCUGCCCGUU | 1321 | CGGGCAGCAGGUCCUUUCUUU | 2824 |
| D-2317 | 848-866 | 731-749 | GAAAGGACCUGCUGCCCGGUU | 1322 | CCGGGCAGCAGGUCCUUUCUU | 2825 |
| D-2318 | 849-867 | 732-750 | AAAGGACCUGCUGCCCGGUUU | 1323 | ACCGGGCAGCAGGUCCUUUUU | 2826 |
| D-2319 | 850-868 | 733-751 | AAGGACCUGCUGCCCGGUCUU | 1324 | GACCGGGCAGCAGGUCCUUUU | 2827 |
| D-2320 | 85-103 | 85-103 | CCCAUCCCCCACUCCCACCUU | 1325 | GGUGGGAGUGGGGGAUGGGUU | 2828 |
| D-2321 | 851-869 | 734-752 | AGGACCUGCUGCCCGGUCAUU | 1326 | UGACCGGGCAGCAGGUCCUUU | 2829 |
| D-2322 | 852-870 | 735-753 | GGACCUGCUGCCCGGUCAAUU | 1327 | UUGACCGGGCAGCAGGUCCUU | 2830 |
| D-2323 | 853-871 | 736-754 | GACCUGCUGCCCGGUCAACUU | 1328 | GUUGACCGGGCAGCAGGUCUU | 2831 |
| D-2324 | 854-872 | 737-755 | ACCUGCUGCCCGGUCAACUUU | 1329 | AGUUGACCGGGCAGCAGGUUU | 2832 |
| D-2325 | 855-873 | 738-756 | CCUGCUGCCCGGUCAACUGUU | 1330 | CAGUUGACCGGGCAGCAGGUU | 2833 |
| D-2326 | 856-874 | 739-757 | CUGCUGCCCGGUCAACUGGUU | 1331 | CCAGUUGACCGGGCAGCAGUU | 2834 |
| D-2327 | 857-875 | 740-758 | UGCUGCCCGGUCAACUGGGUU | 1332 | CCCAGUUGACCGGGCAGCAUU | 2835 |
| D-2328 | 858-876 | 741-759 | GCUGCCCGGUCAACUGGGUUU | 1333 | ACCCAGUUGACCGGGCAGCUU | 2836 |
| D-2329 | 859-877 | 742-760 | CUGCCCGGUCAACUGGGUGUU | 1334 | CACCCAGUUGACCGGGCAGUU | 2837 |
| D-2330 | 860-878 | 743-761 | UGCCCGGUCAACUGGGUGGUU | 1335 | CCACCCAGUUGACCGGGCAUU | 2838 |
| D-2331 | 86-104 | 86-104 | CCAUCCCCCACUCCCACCCUU | 1336 | GGGUGGGAGUGGGGGAUGGUU | 2839 |
| D-2332 | 861-879 | 744-762 | GCCCGGUCAACUGGGUGGAUU | 1337 | UCCACCCAGUUGACCGGGCUU | 2840 |
| D-2333 | 862-880 | 745-763 | CCCGGUCAACUGGGUGGAGUU | 1338 | CUCCACCCAGUUGACCGGGUU | 2841 |
| D-2334 | 863-881 | 746-764 | CCGGUCAACUGGGUGGAGCUU | 1339 | GCUCCACCCAGUUGACCGGUU | 2842 |
| D-2335 | 864-882 | 747-765 | CGGUCAACUGGGUGGAGCAUU | 1340 | UGCUCCACCCAGUUGACCGUU | 2843 |
| D-2336 | 865-883 | 748-766 | GGUCAACUGGGUGGAGCACUU | 1341 | GUGCUCCACCCAGUUGACCUU | 2844 |
| D-2337 | 866-884 | 749-767 | GUCAACUGGGUGGAGCACGUU | 1342 | CGUGCUCCACCCAGUUGACUU | 2845 |
| D-2338 | 867-885 | 750-768 | UCAACUGGGUGGAGCACGAUU | 1343 | UCGUGCUCCACCCAGUUGAUU | 2846 |
| D-2339 | 868-886 | 751-769 | CAACUGGGUGGAGCACGAGUU | 1344 | CUCGUGCUCCACCCAGUUGUU | 2847 |
| D-2340 | 869-887 | 752-770 | AACUGGGUGGAGCACGAGCUU | 1345 | GCUCGUGCUCCACCCAGUUUU | 2848 |
| D-2341 | 870-888 | 753-771 | ACUGGGUGGAGCACGAGCGUU | 1346 | CGCUCGUGCUCCACCCAGUUU | 2849 |
| D-2342 | 87-105 | 87-105 | CAUCCCCCACUCCCACCCCUU | 1347 | GGGGUGGGAGUGGGGGAUGUU | 2850 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-2343 | 871-889 | 754-772 | CUGGGUGGAGCACGAGCGCUU | 1348 | GCGCUCGUGCUCCACCCAGUU | 2851 |
| D-2344 | 872-890 | 755-773 | UGGGUGGAGCACGAGCGCAUU | 1349 | UGCGCUCGUGCUCCACCCAUU | 2852 |
| D-2345 | 873-891 | 756-774 | GGGUGGAGCACGAGCGCAGUU | 1350 | CUGCGCUCGUGCUCCACCCUU | 2853 |
| D-2346 | 874-892 | 757-775 | GGUGGAGCACGAGCGCAGCUU | 1351 | GCUGCGCUCGUGCUCCACCUU | 2854 |
| D-2347 | 875-893 | 758-776 | GUGGAGCACGAGCGCAGCUUU | 1352 | AGCUGCGCUCGUGCUCCACUU | 2855 |
| D-2348 | 876-894 | 759-777 | UGGAGCACGAGCGCAGCUGUU | 1353 | CAGCUGCGCUCGUGCUCCAUU | 2856 |
| D-2349 | 877-895 | 760-778 | GGAGCACGAGCGCAGCUGCUU | 1354 | GCAGCUGCGCUCGUGCUCCUU | 2857 |
| D-2350 | 878-896 | 761-779 | GAGCACGAGCGCAGCUGCUUU | 1355 | AGCAGCUGCGCUCGUGCUCUU | 2858 |
| D-2351 | 879-897 | 762-780 | AGCACGAGCGCAGCUGCUAUU | 1356 | UAGCAGCUGCGCUCGUGCUUU | 2859 |
| D-2352 | 880-898 | 763-781 | GCACGAGCGCAGCUGCUACUU | 1357 | GUAGCAGCUGCGCUCGUGCUU | 2860 |
| D-2353 | 88-106 | 88-106 | AUCCCCCACUCCCACCCCCUU | 1358 | GGGGGUGGGAGUGGGGGAUUU | 2861 |
| D-2354 | 881-899 | 764-782 | CACGAGCGCAGCUGCUACUUU | 1359 | AGUAGCAGCUGCGCUCGUGUU | 2862 |
| D-2355 | 882-900 | 765-783 | ACGAGCGCAGCUGCUACUGUU | 1360 | CAGUAGCAGCUGCGCUCGUUU | 2863 |
| D-2356 | 883-901 | 766-784 | CGAGCGCAGCUGCUACUGGUU | 1361 | CCAGUAGCAGCUGCGCUCGUU | 2864 |
| D-2357 | 884-902 | 767-785 | GAGCGCAGCUGCUACUGGUUU | 1362 | ACCAGUAGCAGCUGCGCUCUU | 2865 |
| D-2358 | 885-903 | 768-786 | AGCGCAGCUGCUACUGGUUUU | 1363 | AACCAGUAGCAGCUGCGCUUU | 2866 |
| D-2359 | 886-904 | 769-787 | GCGCAGCUGCUACUGGUUCUU | 1364 | GAACCAGUAGCAGCUGCGCUU | 2867 |
| D-2360 | 887-905 | 770-788 | CGCAGCUGCUACUGGUUCUUU | 1365 | AGAACCAGUAGCAGCUGCGUU | 2868 |
| D-2361 | 888-906 | 771-789 | GCAGCUGCUACUGGUUCUCUU | 1366 | GAGAACCAGUAGCAGCUGCUU | 2869 |
| D-2362 | 889-907 | 772-790 | CAGCUGCUACUGGUUCUCUUU | 1367 | AGAGAACCAGUAGCAGCUGUU | 2870 |
| D-2363 | 890-908 | 773-791 | AGCUGCUACUGGUUCUCUCUU | 1368 | GAGAGAACCAGUAGCAGCUUU | 2871 |
| D-2364 | 89-107 | 89-107 | UCCCCCACUCCCACCCCCAUU | 1369 | UGGGGGUGGGAGUGGGGGAUU | 2872 |
| D-2365 | 891-909 | 774-792 | GCUGCUACUGGUUCUCUCGUU | 1370 | CGAGAGAACCAGUAGCAGCUU | 2873 |
| D-2366 | 892-910 | 775-793 | CUGCUACUGGUUCUCUCGCUU | 1371 | GCGAGAGAACCAGUAGCAGUU | 2874 |
| D-2367 | 893-911 | 776-794 | UGCUACUGGUUCUCUCGCUUU | 1372 | AGCGAGAGAACCAGUAGCAUU | 2875 |
| D-2368 | 894-912 | 777-795 | GCUACUGGUUCUCUCGCUCUU | 1373 | GAGCGAGAGAACCAGUAGCUU | 2876 |
| D-2369 | 895-913 | 778-796 | CUACUGGUUCUCUCGCUCCUU | 1374 | GGAGCGAGAGAACCAGUAGUU | 2877 |
| D-2370 | 896-914 | 779-797 | UACUGGUUCUCUCGCUCCGUU | 1375 | CGGAGCGAGAGAACCAGUAUU | 2878 |
| D-2371 | 897-915 | 780-798 | ACUGGUUCUCUCGCUCCGGUU | 1376 | CCGGAGCGAGAGAACCAGUUU | 2879 |
| D-2372 | 898-916 | 781-799 | CUGGUUCUCUCGCUCCGGGUU | 1377 | CCCGGAGCGAGAGAACCAGUU | 2880 |
| D-2373 | 899-917 | 782-800 | UGGUUCUCUCGCUCCGGGAUU | 1378 | UCCCGGAGCGAGAGAACCAUU | 2881 |
| D-2374 | 900-918 | 783-801 | GGUUCUCUCGCUCCGGGAAUU | 1379 | UUCCCGGAGCGAGAGAACCUU | 2882 |
| D-2375 | 90-108 | 90-108 | CCCCCACUCCCACCCCCACUU | 1380 | GUGGGGUGGGAGUGGGGGUU | 2883 |
| D-2376 | 901-919 | 784-802 | GUUCUCUCGCUCCGGGAAGUU | 1381 | CUUCCCGGAGCGAGAGAACUU | 2884 |
| D-2377 | 902-920 | 785-803 | UUCUCUCGCUCCGGGAAGGUU | 1382 | CCUUCCCGGAGCGAGAGAAUU | 2885 |
| D-2378 | 903-921 | 786-804 | UCUCUCGCUCCGGGAAGGCUU | 1383 | GCCUUCCCGGAGCGAGAGAUU | 2886 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-2379 | 904-922 | 787-805 | CUCUCGCUCCGGGAAGGCCUU | 1384 | GGCCUUCCCGGAGCGAGAGUU | 2887 |
| D-2380 | 905-923 | 788-806 | UCUCGCUCCGGGAAGGCCUUU | 1385 | AGGCCUUCCCGGAGCGAGAUU | 2888 |
| D-2381 | 906-924 | 789-807 | CUCGCUCCGGGAAGGCCUGUU | 1386 | CAGGCCUUCCCGGAGCGAGUU | 2889 |
| D-2382 | 907-925 | 790-808 | UCGCUCCGGGAAGGCCUGGUU | 1387 | CCAGGCCUUCCCGGAGCGAUU | 2890 |
| D-2383 | 908-926 | 791-809 | CGCUCCGGGAAGGCCUGGGUU | 1388 | CCCAGGCCUUCCCGGAGCGUU | 2891 |
| D-2384 | 909-927 | 792-810 | GCUCCGGGAAGGCCUGGGCUU | 1389 | GCCCAGGCCUUCCCGGAGCUU | 2892 |
| D-2385 | 910-928 | 793-811 | CUCCGGGAAGGCCUGGGCUUU | 1390 | AGCCCAGGCCUUCCCGGAGUU | 2893 |
| D-2386 | 91-109 | 91-109 | CCCCACUCCCACCCCCACAUU | 1391 | UGUGGGGUGGGAGUGGGGUU | 2894 |
| D-2387 | 911-929 | 794-812 | UCCGGGAAGGCCUGGGCUGUU | 1392 | CAGCCCAGGCCUUCCCGGAUU | 2895 |
| D-2388 | 912-930 | 795-813 | CCGGGAAGGCCUGGGCUGAUU | 1393 | UCAGCCCAGGCCUUCCCGGUU | 2896 |
| D-2389 | 913-931 | 796-814 | CGGGAAGGCCUGGGCUGACUU | 1394 | GUCAGCCCAGGCCUUCCCGUU | 2897 |
| D-2390 | 914-932 | 797-815 | GGGAAGGCCUGGGCUGACGUU | 1395 | CGUCAGCCCAGGCCUUCCCUU | 2898 |
| D-2391 | 915-933 | 798-816 | GGAAGGCCUGGGCUGACGCUU | 1396 | GCGUCAGCCCAGGCCUUCCUU | 2899 |
| D-2392 | 916-934 | 799-817 | GAAGGCCUGGGCUGACGCCUU | 1397 | GGCGUCAGCCCAGGCCUUCUU | 2900 |
| D-2393 | 917-935 | 800-818 | AAGGCCUGGGCUGACGCCGUU | 1398 | CGGCGUCAGCCCAGGCCUUUU | 2901 |
| D-2394 | 918-936 | 801-819 | AGGCCUGGGCUGACGCCGAUU | 1399 | UCGGCGUCAGCCCAGGCCUUU | 2902 |
| D-2395 | 919-937 | 802-820 | GGCCUGGGCUGACGCCGACUU | 1400 | GUCGGCGUCAGCCCAGGCCUU | 2903 |
| D-2396 | 920-938 | 803-821 | GCCUGGGCUGACGCCGACAUU | 1401 | UGUCGGCGUCAGCCCAGGCUU | 2904 |
| D-2397 | 92-110 | 92-110 | CCCACUCCCACCCCCACACUU | 1402 | GUGUGGGGUGGGAGUGGGUU | 2905 |
| D-2398 | 921-939 | 804-822 | CCUGGGCUGACGCCGACAAUU | 1403 | UUGUCGGCGUCAGCCCAGGUU | 2906 |
| D-2399 | 922-940 | 805-823 | CUGGGCUGACGCCGACAACUU | 1404 | GUUGUCGGCGUCAGCCCAGUU | 2907 |
| D-2400 | 923-941 | 806-824 | UGGGCUGACGCCGACAACUUU | 1405 | AGUUGUCGGCGUCAGCCCAUU | 2908 |
| D-2401 | 924-942 | 807-825 | GGGCUGACGCCGACAACUAUU | 1406 | UAGUUGUCGGCGUCAGCCCUU | 2909 |
| D-2402 | 925-943 | 808-826 | GGCUGACGCCGACAACUACUU | 1407 | GUAGUUGUCGGCGUCAGCCUU | 2910 |
| D-2403 | 926-944 | 809-827 | GCUGACGCCGACAACUACUUU | 1408 | AGUAGUUGUCGGCGUCAGCUU | 2911 |
| D-2404 | 9-27 | 9-27 | GUGCACGGAAGAGUGAGGUUU | 1409 | ACCUCACUCUUCCGUGCACUU | 2912 |
| D-2405 | 927-945 | 810-828 | CUGACGCCGACAACUACUGUU | 1410 | CAGUAGUUGUCGGCGUCAGUU | 2913 |
| D-2406 | 928-946 | 811-829 | UGACGCCGACAACUACUGCUU | 1411 | GCAGUAGUUGUCGGCGUCAUU | 2914 |
| D-2407 | 929-947 | 812-830 | GACGCCGACAACUACUGCCUU | 1412 | GGCAGUAGUUGUCGGCGUCUU | 2915 |
| D-2408 | 930-948 | 813-831 | ACGCCGACAACUACUGCCGUU | 1413 | CGGCAGUAGUUGUCGGCGUUU | 2916 |
| D-2409 | 93-111 | 93-111 | CCACUCCCACCCCCACACUUU | 1414 | AGUGUGGGGGUGGGAGUGGUU | 2917 |
| D-2410 | 931-949 | 814-832 | CGCCGACAACUACUGCCGGUU | 1415 | CCGGCAGUAGUUGUCGGCGUU | 2918 |
| D-2411 | 932-950 | 815-833 | GCCGACAACUACUGCCGGCUU | 1416 | GCCGGCAGUAGUUGUCGGCUU | 2919 |
| D-2412 | 933-951 | 816-834 | CCGACAACUACUGCCGGCUUU | 1417 | AGCCGGCAGUAGUUGUCGGUU | 2920 |
| D-2413 | 934-952 | 817-835 | CGACAACUACUGCCGGCUGUU | 1418 | CAGCCGGCAGUAGUUGUCGUU | 2921 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-2414 | 935-953 | 818-836 | GACAACUACUGCCGGCUGGUU | 1419 | CCAGCCGGCAGUAGUUGUCUU | 2922 |
| D-2415 | 936-954 | 819-837 | ACAACUACUGCCGGCUGGAUU | 1420 | UCCAGCCGGCAGUAGUUGUUU | 2923 |
| D-2416 | 937-955 | 820-838 | CAACUACUGCCGGCUGGAGUU | 1421 | CUCCAGCCGGCAGUAGUUGUU | 2924 |
| D-2417 | 938-956 | 821-839 | AACUACUGCCGGCUGGAGGUU | 1422 | CCUCCAGCCGGCAGUAGUUUU | 2925 |
| D-2418 | 939-957 | 822-840 | ACUACUGCCGGCUGGAGGAUU | 1423 | UCCUCCAGCCGGCAGUAGUUU | 2926 |
| D-2419 | 940-958 | 823-841 | CUACUGCCGGCUGGAGGACUU | 1424 | GUCCUCCAGCCGGCAGUAGUU | 2927 |
| D-2420 | 94-112 | 94-112 | CACUCCCACCCCACACUCUU | 1425 | GAGUGUGGGGUGGGAGUGUU | 2928 |
| D-2421 | 941-959 | 824-842 | UACUGCCGGCUGGAGGACGUU | 1426 | CGUCCUCCAGCCGGCAGUAUU | 2929 |
| D-2422 | 942-960 | 825-843 | ACUGCCGGCUGGAGGACGCUU | 1427 | GCGUCCUCCAGCCGGCAGUUU | 2930 |
| D-2423 | 943-961 | 826-844 | CUGCCGGCUGGAGGACGCGUU | 1428 | CGCGUCCUCCAGCCGGCAGUU | 2931 |
| D-2424 | 944-962 | 827-845 | UGCCGGCUGGAGGACGCGCUU | 1429 | GCGCGUCCUCCAGCCGGCAUU | 2932 |
| D-2425 | 945-963 | 828-846 | GCCGGCUGGAGGACGCGCAUU | 1430 | UGCGCGUCCUCCAGCCGGCUU | 2933 |
| D-2426 | 946-964 | 829-847 | CCGGCUGGAGGACGCGCACUU | 1431 | GUGCGCGUCCUCCAGCCGGUU | 2934 |
| D-2427 | 947-965 | 830-848 | CGGCUGGAGGACGCGCACCUU | 1432 | GGUGCGCGUCCUCCAGCCGUU | 2935 |
| D-2428 | 948-966 | 831-849 | GGCUGGAGGACGCGCACCUUU | 1433 | AGGUGCGCGUCCUCCAGCCUU | 2936 |
| D-2429 | 949-967 | 832-850 | GCUGGAGGACGCGCACCUGUU | 1434 | CAGGUGCGCGUCCUCCAGCUU | 2937 |
| D-2430 | 950-968 | 833-851 | CUGGAGGACGCGCACCUGGUU | 1435 | CCAGGUGCGCGUCCUCCAGUU | 2938 |
| D-2431 | 95-113 | 95-113 | ACUCCCACCCCACACUCCUU | 1436 | GGAGUGUGGGGUGGGAGUUU | 2939 |
| D-2432 | 951-969 | 834-852 | UGGAGGACGCGCACCUGGUUU | 1437 | ACCAGGUGCGCGUCCUCCAUU | 2940 |
| D-2433 | 952-970 | 835-853 | GGAGGACGCGCACCUGGUGUU | 1438 | CACCAGGUGCGCGUCCUCCUU | 2941 |
| D-2434 | 953-971 | 836-854 | GAGGACGCGCACCUGGUGGUU | 1439 | CCACCAGGUGCGCGUCCUCUU | 2942 |
| D-2435 | 954-972 | 837-855 | AGGACGCGCACCUGGUGGUUU | 1440 | ACCACCAGGUGCGCGUCCUUU | 2943 |
| D-2436 | 955-973 | 838-856 | GGACGCGCACCUGGUGGUGUU | 1441 | CACCACCAGGUGCGCGUCCUU | 2944 |
| D-2437 | 956-974 | 839-857 | GACGCGCACCUGGUGGUGGUU | 1442 | CCACCACCAGGUGCGCGUCUU | 2945 |
| D-2438 | 957-975 | 840-858 | ACGCGCACCUGGUGGUGGUUU | 1443 | ACCACCACCAGGUGCGCGUUU | 2946 |
| D-2439 | 958-976 | 841-859 | CGCGCACCUGGUGGUGGUCUU | 1444 | GACCACCACCAGGUGCGCGUU | 2947 |
| D-2440 | 959-977 | 842-860 | GCGCACCUGGUGGUGGUCAUU | 1445 | UGACCACCACCAGGUGCGCUU | 2948 |
| D-2441 | 960-978 | 843-861 | CGCACCUGGUGGUGGUCACUU | 1446 | GUGACCACCACCAGGUGCGUU | 2949 |
| D-2442 | 96-114 | 96-114 | CUCCCACCCCACACUCCCUU | 1447 | GGGAGUGUGGGGUGGGAGUU | 2950 |
| D-2443 | 961-979 | 844-862 | GCACCUGGUGGUGGUCACGUU | 1448 | CGUGACCACCACCAGGUGCUU | 2951 |
| D-2444 | 962-980 | 845-863 | CACCUGGUGGUGGUCACGUUU | 1449 | ACGUGACCACCACCAGGUGUU | 2952 |
| D-2445 | 963-981 | 846-864 | ACCUGGUGGUGGUCACGUCUU | 1450 | GACGUGACCACCACCAGGUUU | 2953 |
| D-2446 | 964-982 | 847-865 | CCUGGUGGUGGUCACGUCCUU | 1451 | GGACGUGACCACCACCAGGUU | 2954 |
| D-2447 | 965-983 | 848-866 | CUGGUGGUGGUCACGUCCUUU | 1452 | AGGACGUGACCACCACCAGUU | 2955 |
| D-2448 | 966-984 | 849-867 | UGGUGGUGGUCACGUCCUGUU | 1453 | CAGGACGUGACCACCACCAUU | 2956 |
| D-2449 | 967-985 | 850-868 | GGUGGUGGUCACGUCCUGGUU | 1454 | CCAGGACGUGACCACCACCUU | 2957 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-2450 | 968-986 | 851-869 | GUGGUGGUCACGUCCUGGGUU | 1455 | CCCAGGACGUGACCACCACUU | 2958 |
| D-2451 | 969-987 | 852-870 | UGGUGGUCACGUCCUGGGAUU | 1456 | UCCCAGGACGUGACCACCAUU | 2959 |
| D-2452 | 970-988 | 853-871 | GGUGGUCACGUCCUGGGAGUU | 1457 | CUCCCAGGACGUGACCACCUU | 2960 |
| D-2453 | 97-115 | 97-115 | UCCCACCCCCACACUCCCCUU | 1458 | GGGGAGUGUGGGGGUGGGAUU | 2961 |
| D-2454 | 971-989 | 854-872 | GUGGUCACGUCCUGGGAGGUU | 1459 | CCUCCCAGGACGUGACCACUU | 2962 |
| D-2455 | 972-990 | 855-873 | UGGUCACGUCCUGGGAGGAUU | 1460 | UCCUCCCAGGACGUGACCAUU | 2963 |
| D-2456 | 973-991 | 856-874 | GGUCACGUCCUGGGAGGAGUU | 1461 | CUCCUCCCAGGACGUGACCUU | 2964 |
| D-2457 | 974-992 | 857-875 | GUCACGUCCUGGGAGGAGCUU | 1462 | GCUCCUCCCAGGACGUGACUU | 2965 |
| D-2458 | 975-993 | 858-876 | UCACGUCCUGGGAGGAGCAUU | 1463 | UGCUCCUCCCAGGACGUGAUU | 2966 |
| D-2459 | 976-994 | 859-877 | CACGUCCUGGGAGGAGCAGUU | 1464 | CUGCUCCUCCCAGGACGUGUU | 2967 |
| D-2460 | 977-995 | 860-878 | ACGUCCUGGGAGGAGCAGAUU | 1465 | UCUGCUCCUCCCAGGACGUUU | 2968 |
| D-2461 | 978-996 | 861-879 | CGUCCUGGGAGGAGCAGAAUU | 1466 | UUCUGCUCCUCCCAGGACGUU | 2969 |
| D-2462 | 979-997 | 862-880 | GUCCUGGGAGGAGCAGAAAUU | 1467 | UUUCUGCUCCUCCCAGGACUU | 2970 |
| D-2463 | 980-998 | 863-881 | UCCUGGGAGGAGCAGAAAUUU | 1468 | AUUUCUGCUCCUCCCAGGAUU | 2971 |
| D-2464 | 98-116 | 98-116 | CCCACCCCCACACUCCCCUUU | 1469 | AGGGGAGUGUGGGGGUGGGUU | 2972 |
| D-2465 | 981-999 | 864-882 | CCUGGGAGGAGCAGAAAUUUU | 1470 | AAUUUCUGCUCCUCCCAGGUU | 2973 |
| D-2466 | 982-1000 | 865-883 | CUGGGAGGAGCAGAAAUUUUU | 1471 | AAAUUUCUGCUCCUCCCAGUU | 2974 |
| D-2467 | 983-1001 | 866-884 | UGGGAGGAGCAGAAAUUUGUU | 1472 | CAAAUUUCUGCUCCUCCCAUU | 2975 |
| D-2468 | 984-1002 | 867-885 | GGGAGGAGCAGAAAUUUGUUU | 1473 | ACAAAUUUCUGCUCCUCCCUU | 2976 |
| D-2469 | 985-1003 | 868-886 | GGAGGAGCAGAAAUUUGUCUU | 1474 | GACAAAUUUCUGCUCCUCCUU | 2977 |
| D-2470 | 986-1004 | 869-887 | GAGGAGCAGAAAUUUGUCCUU | 1475 | GGACAAAUUUCUGCUCCUCUU | 2978 |
| D-2471 | 987-1005 | 870-888 | AGGAGCAGAAAUUUGUCCAUU | 1476 | UGGACAAAUUUCUGCUCCUUU | 2979 |
| D-2472 | 988-1006 | 871-889 | GGAGCAGAAAUUUGUCCAGUU | 1477 | CUGGACAAAUUUCUGCUCCUU | 2980 |
| D-2473 | 989-1007 | 872-890 | GAGCAGAAAUUUGUCCAGCUU | 1478 | GCUGGACAAAUUUCUGCUCUU | 2981 |
| D-2474 | 990-1008 | 873-891 | AGCAGAAAUUUGUCCAGCAUU | 1479 | UGCUGGACAAAUUUCUGCUUU | 2982 |
| D-2475 | 991-1009 | 874-892 | GCAGAAAUUUGUCCAGCACUU | 1480 | GUGCUGGACAAAUUUCUGCUU | 2983 |
| D-2476 | 99-117 | 99-117 | CCACCCCCACACUCCCCUAUU | 1481 | UAGGGGAGUGUGGGGGUGGUU | 2984 |
| D-2477 | 992-1010 | 875-893 | CAGAAAUUUGUCCAGCACCUU | 1482 | GGUGCUGGACAAAUUUCUGUU | 2985 |
| D-2478 | 993-1011 | 876-894 | AGAAAUUUGUCCAGCACCAUU | 1483 | UGGUGCUGGACAAAUUUCUUU | 2986 |
| D-2479 | 994-1012 | 877-895 | GAAAUUUGUCCAGCACCACUU | 1484 | GUGGUGCUGGACAAAUUUCUU | 2987 |
| D-2480 | 995-1013 | 878-896 | AAAUUUGUCCAGCACCACAUU | 1485 | UGUGGUGCUGGACAAAUUUUU | 2988 |
| D-2481 | 996-1014 | 879-897 | AAUUUGUCCAGCACCACAUUU | 1486 | AUGUGGUGCUGGACAAAUUUU | 2989 |
| D-2482 | 997-1015 | 880-898 | AUUUGUCCAGCACCACAUAUU | 1487 | UAUGUGGUGCUGGACAAAUUU | 2990 |
| D-2483 | 998-1016 | 881-899 | UUUGUCCAGCACCACAUAGUU | 1488 | CUAUGUGGUGCUGGACAAAUU | 2991 |
| D-2484 | 999-1017 | 882-900 | UUGUCCAGCACCACAUAGGUU | 1489 | CCUAUGUGGUGCUGGACAAUU | 2992 |

TABLE 1-continued

ASGR1 siRNA Sequences

| Duplex No. | Target site of antisense sequence within NM_001671.4 | Target site of antisense sequence within NM_001197216.2 | Sense Sequence (5'-3') | SEQ ID NO: sense | Antisense Sequence (5'-3') | SEQ ID NO: antisense |
|---|---|---|---|---|---|---|
| D-2485 | — | 453-471 | ACCAUCAGCUCAGAAAAGAUU | 1490 | UCUUUUCUGAGCUGAUGGUUU | 2993 |
| D-2486 | — | 454-472 | CCAUCAGCUCAGAAAAGACUU | 1491 | GUCUUUUCUGAGCUGAUGGUU | 2994 |
| D-2487 | — | 455-473 | CAUCAGCUCAGAAAAGACUUU | 1492 | AGUCUUUUCUGAGCUGAUGUU | 2995 |
| D-2488 | — | 456-474 | AUCAGCUCAGAAAAGACUCUU | 1493 | GAGUCUUUUCUGAGCUGAUUU | 2996 |
| D-2489 | — | 457-475 | UCAGCUCAGAAAAGACUCCUU | 1494 | GGAGUCUUUUCUGAGCUGAUU | 2997 |
| D-2490 | — | 458-476 | CAGCUCAGAAAAGACUCCCUU | 1495 | GGGAGUCUUUUCUGAGCUGUU | 2998 |
| D-2491 | — | 459-477 | AGCUCAGAAAAGACUCCCAUU | 1496 | UGGGAGUCUUUUCUGAGCUUU | 2999 |
| D-2492 | — | 460-478 | GCUCAGAAAAGACUCCCAGUU | 1497 | CUGGGAGUCUUUUCUGAGCUU | 3000 |
| D-2493 | — | 461-479 | CUCAGAAAAGACUCCCAGCUU | 1498 | GCUGGGAGUCUUUUCUGAGUU | 3001 |
| D-2494 | — | 462-480 | UCAGAAAAGACUCCCAGCUUU | 1499 | AGCUGGGAGUCUUUUCUGAUU | 3002 |
| D-2495 | — | 463-481 | CAGAAAAGACUCCCAGCUGUU | 1500 | CAGCUGGGAGUCUUUUCUGUU | 3003 |
| D-2496 | — | 464-482 | AGAAAAGACUCCCAGCUGCUU | 1501 | GCAGCUGGGAGUCUUUUCUUU | 3004 |
| D-2497 | — | 465-483 | GAAAAGACUCCCAGCUGCAUU | 1502 | UGCAGCUGGGAGUCUUUUCUU | 3005 |
| D-2498 | — | 466-484 | AAAAGACUCCCAGCUGCAGUU | 1503 | CUGCAGCUGGGAGUCUUUUUU | 3006 |
| D-2499 | — | 467-485 | AAAGACUCCCAGCUGCAGGUU | 1504 | CCUGCAGCUGGGAGUCUUUUU | 3007 |
| D-2500 | — | 468-486 | AAGACUCCCAGCUGCAGGAUU | 1505 | UCCUGCAGCUGGGAGUCUUUU | 3008 |
| D-2501 | — | 469-487 | AGACUCCCAGCUGCAGGAGUU | 1506 | CUCCUGCAGCUGGGAGUCUUU | 3009 |
| D-2502 | — | 470-488 | GACUCCCAGCUGCAGGAGGUU | 1507 | CCUCCUGCAGCUGGGAGUCUU | 3010 |

Example 2

Efficacy of ASGR1 siRNA Molecules In Vitro

The siRNA molecules in Tier 1 and Tier 2 screening sets were synthesized without chemical modifications. Each siRNA molecule was comprised of a 21 nucleotide sense strand and 21 nucleotide antisense strand that hybridized to form a duplex region of 19 base pairs with a 2 nucleotide overhang at the 3' end of each strand. The efficacy of each of the siRNA molecules in reducing ASGR1 expression was assessed using a 384-well format in vitro immunoassay, which quantifies levels of ASGR1 protein on the cell surface of Hep3B or HepG2 cells.

Transfection complexes of the siRNA molecules and RNAiMax transfection reagent (Life Technologies) in EMEM media (ATCC 30-2003) were prepared in 384-well plates in accordance with manufacturer's recommendations. Human hepatocellular carcinoma Hep3B (ATCC HB-8064) or HepG2 (ATCC HB-8065) cells in EMEM media supplemented with 10% fetal bovine serum and 1% antibiotic/antimycotic were added to each well. Cells were incubated for 4 days at 37° C. and 5% $CO_2$. Four days after siRNA transfection, cells were fixed in formaldehyde, blocked with bovine serum albumin, and subsequently stained with an anti-ASGR1 primary antibody (Amgen clone 7E11, light and heavy chain sequences provided below (SEQ ID NOs: 3 and 4)) for either 1 hour at room temperature or overnight at 4° C. Plates were washed three times with phosphate buffered saline (PBS). Cells were then incubated in the dark for 45 minutes at room temperature with Alexa488-conjugated anti-human IgG secondary antibody and nuclear stain DRAQ5 (ThermoFisher #62251), which was included to assess cell number. Following three PBS washes, the plates were imaged on an Opera Phenix high-content screening system (PerkinElmer) using the 488 and 640 channels to measure anti-ASGR1 antibody staining and nuclear staining, respectively. Data was analyzed using Columbus image analysis software and GeneData Screener software to quantify several measures of ASGR1 protein levels, cell count, and cell morphology on a per cell and per well basis.

Anti-ASGR1 primary antibody light chain amino acid sequence:

(SEQ ID NO: 3)
DIQMTQSPSSLSASVGDRVTIACRASQNIISYLNWYQQKPGKAPKFLIYT

ASSLQSGVPSRFSGSGSGTDFTLTISSLQPEDFAIYYCQQTYSTPLTFGG

GTKVEIKRTVAAPSVFIFPPSDEQLKSGTASVVCLLNNFYPREAKVQWKV

DNALQSGNSQESVTEQDSKDSTYSLSSTLTLSKADYEKHKVYACEVTHQG

LSSPVTKSFNRGEC

Anti-ASGR1 primary antibody heavy chain amino acid sequence:

(SEQ ID NO: 4)
QVQLVESGGGVVQPGRSLRLSCAASGFTFSSFGMHWVRQAPGKGLEWVAI

IWHDGSNKYYADSVKGRFTISRDNSKNTLYLQMSSLRAEDTAVYYCARDL

SMGGMDVWGQGTTVTVSSASTKGPSVFPLAPSSKSTSGGTAALGCLVKDY

FPEPVTVSWNSGALTSGVHTFPAVLQSSGLYSLSSVVTVPSSSLGTQTYI

CNVNHKPSNTKVDKKVEPKSCDKTHTCPPCPAPELLGGPSVFLFPPKPKD

TLMISRTPEVTCVVVDVSHEDPEVKFNWYVDGVEVHNAKTKPCEEQYGST

YRCVSVLTVLHQDWLNGKEYKCKVSNKALPAPIEKTISKAKGQPREPQVY

TLPPSREEMTKNQVSLTCLVKGFYPSDIAVEWESNGQPENNYKTTPPVLD

SDGSFFLYSKLTVDKSRWQQGNVFSCSVMHEALHNHYTQKSLSLSPGK

Activity of each siRNA molecule was measured using a "Normalized Alexa 488 Mean Intensity" readout, which quantifies ASGR1 protein expression based on cell population analysis relative to ASGR1 expression in control cell populations. Cells transfected with non-targeting siRNA duplexes (i.e. siRNAs that do not have a 100% sequence match to any human gene sequences) were used as controls on each plate and a "central reference value" was calculated from these control cells. Specifically, the "central reference value" was the median value of the Alexa 488 intensity of the multiple wells containing cells transfected with non-targeting siRNAs. The "Normalized Alexa 488 Mean Intensity" was calculated for each well as follows. Nuclei and cytoplasm were segmented using the DRAQ5 counterstain. The mean Alexa488 fluorescence intensity for each cell (i.e. the entire cellular region, including cytoplasm and nucleus) was measured. Individual cell values were averaged to produce a mean Alexa 488 intensity value for each well. This mean intensity value was then normalized to the central reference value to arrive at the "Normalized Alexa 488 Mean Intensity" value, which represents an ASGR1 expression measurement as a percent of control. Thus, negative "Normalized Alexa 488 Mean Intensity" values represent a reduced ASGR1 expression relative to control cells. Cell counts as assessed by the DRAQ5 stain were also normalized to cell counts for control cells and thus, represent a cell viability measurement as a percent of control.

The Tier 1 siRNA molecules were tested in duplicate at three different concentrations (0.3 nM, 1.25 nM, and 5 nM) in the in vitro immunoassay in both Hep3B cells and HepG2 cells. The reduction in ASGR1 cell surface expression relative to expression in cells transfected with non-targeting siRNAs in Hep3B cells for each siRNA molecule is shown in Table 2 below. Cell count measurements are also provided. For clarity, the data for the lowest concentration (0.3 nM) and the data for the HepG2 cells are not shown. The data shown in Table 2 are the results from two independent transfections of each siRNA (e.g. Run 1 and Run 2).

TABLE 2

In vitro efficacy of Tier 1 ASGR1 siRNA molecules in immunoassay screen

| Duplex No. | Run 1 | | | | Run 2 | | | |
| --- | --- | --- | --- | --- | --- | --- | --- | --- |
| | Cell count 5 nM | Normalized Alexa 488 Mean Intensity 5 nM | Cell count 1.25 nM | Normalized Alexa 488 Mean Intensity 1.25 nM | Cell count 5 nM | Normalized Alexa 488 Mean Intensity 5 nM | Cell count 1.25 nM | Normalized Alexa 488 Mean Intensity 1.25 nM |
| D-1011 | 16.51 | −51.78 | 0.13 | −14.40 | 25.37 | −51.83 | 3.76 | −28.05 |
| D-1018 | −17.30 | −55.17 | 2.29 | −16.02 | −34.78 | −52.13 | 30.89 | −7.73 |
| D-1024 | −29.00 | −18.51 | −0.82 | 12.30 | 1.97 | 14.82 | 6.60 | 4.61 |
| D-1036 | −46.65 | 10.97 | −10.56 | 7.07 | −18.48 | 71.68 | 1.10 | 12.95 |
| D-1055 | 10.56 | −13.14 | −1.08 | −9.93 | 7.75 | −24.90 | 11.92 | −7.81 |
| D-1063 | 9.47 | −18.69 | −2.54 | −11.47 | −25.16 | −50.11 | −10.17 | −18.86 |
| D-1069 | −20.87 | −41.89 | −4.27 | 3.93 | −11.39 | −28.60 | 12.28 | 7.84 |
| D-1082 | 17.70 | −48.78 | −8.32 | −14.13 | −0.15 | −55.38 | −5.13 | −50.19 |
| D-1089 | −35.75 | −60.09 | −12.25 | −36.42 | −25.97 | −57.46 | −7.24 | −51.34 |
| D-1091 | −18.99 | −31.14 | −13.76 | 5.02 | −27.59 | −20.03 | 3.02 | −6.61 |
| D-1098 | 6.89 | −54.37 | −2.80 | −34.02 | −14.23 | −59.04 | −11.92 | −53.04 |
| D-1135 | 10.36 | −7.69 | −15.39 | −4.17 | 24.96 | −24.64 | 3.57 | −5.25 |
| D-1147 | 20.97 | −3.11 | 4.36 | 1.69 | 11.90 | 5.13 | 13.93 | 4.34 |
| D-1151 | −4.71 | −14.13 | −15.57 | −17.87 | −12.91 | −34.11 | −1.19 | −14.79 |
| D-1158 | 26.52 | −10.17 | 23.24 | 8.03 | 28.20 | −6.52 | 18.06 | −2.88 |
| D-1162 | −40.01 | −55.60 | −22.04 | −36.60 | −35.29 | −52.50 | −14.02 | −41.72 |
| D-1165 | −3.62 | −54.73 | −7.63 | −23.22 | −0.86 | −51.86 | 15.67 | −18.51 |
| D-1166 | −3.32 | −41.79 | −11.34 | −13.26 | −0.25 | −14.66 | −4.12 | −15.13 |
| D-1167 | −53.20 | −59.29 | −6.34 | −16.20 | −34.68 | −52.65 | 2.38 | −24.06 |
| D-1168 | −31.18 | −46.37 | −1.51 | −9.31 | −4.10 | −34.17 | −15.22 | −20.42 |
| D-1170 | −12.35 | −53.90 | −3.32 | −42.65 | −23.85 | −56.63 | 5.59 | −32.93 |
| D-1171 | 3.82 | −31.95 | −14.62 | −23.16 | −12.00 | −49.39 | 9.90 | −28.40 |
| D-1172 | −45.07 | −58.26 | −1.94 | 3.83 | −40.15 | −56.40 | −18.42 | −45.04 |
| D-1173 | −25.53 | −57.81 | 5.39 | −8.67 | −12.00 | −58.53 | −24.75 | −56.05 |
| D-1174 | 11.06 | −32.05 | 3.06 | −15.60 | −18.38 | −54.41 | −13.38 | −40.99 |
| D-1175 | −35.25 | −47.56 | −9.96 | −1.38 | −31.75 | −44.76 | −24.47 | −34.12 |
| D-1176 | −21.07 | −48.99 | −12.46 | −22.28 | −55.65 | −30.89 | −4.67 | −34.03 |
| D-1206 | −20.58 | −58.56 | −5.65 | −42.60 | −4.41 | −58.69 | 13.47 | −45.33 |
| D-1234 | 0.74 | −45.36 | −6.51 | 4.14 | 13.42 | −37.24 | −0.46 | −19.91 |
| D-1235 | −11.85 | −55.44 | −20.74 | −53.47 | −36.41 | −59.01 | −20.26 | −54.37 |
| D-1237 | −20.08 | −20.98 | 5.99 | 19.18 | 4.30 | −22.26 | 0.55 | −4.37 |
| D-1246 | 18.79 | −44.97 | −0.22 | −40.27 | −18.38 | −57.87 | 7.97 | −44.91 |
| D-1250 | −6.10 | −51.90 | 0.82 | 2.19 | 0.15 | −58.42 | 10.08 | −49.16 |
| D-1257 | −10.36 | −55.00 | 5.39 | 16.17 | −20.30 | −53.64 | −15.58 | −41.86 |

TABLE 2-continued

In vitro efficacy of Tier 1 ASGR1 siRNA molecules in immunoassay screen

| | Run 1 | | | | Run 2 | | | |
|---|---|---|---|---|---|---|---|---|
| Duplex No. | Cell count 5 nM | Normalized Alexa 488 Mean Intensity 5 nM | Cell count 1.25 nM | Normalized Alexa 488 Mean Intensity 1.25 nM | Cell count 5 nM | Normalized Alexa 488 Mean Intensity 5 nM | Cell count 1.25 nM | Normalized Alexa 488 Mean Intensity 1.25 nM |
| D-1285 | −15.32 | −50.05 | 8.93 | 9.74 | −18.08 | −56.70 | −12.37 | −45.36 |
| D-1286 | −30.00 | −55.94 | −0.69 | −28.77 | −11.19 | −48.78 | −2.70 | −42.37 |
| D-1288 | −26.13 | −60.85 | 3.32 | −3.82 | −9.16 | −56.60 | 8.07 | −36.50 |
| D-1289 | −11.95 | −48.94 | −13.41 | −9.24 | −3.49 | −53.30 | −9.72 | −31.07 |
| D-1291 | −21.57 | −62.92 | −2.37 | 4.10 | 10.28 | −57.93 | −5.22 | −46.85 |
| D-1293 | 7.88 | −59.68 | −4.18 | −17.53 | −1.47 | −60.64 | 1.56 | −48.52 |
| D-1294 | −13.93 | −61.42 | 9.01 | −8.13 | 4.20 | −58.50 | 7.79 | −49.89 |
| D-1296 | 32.37 | −35.87 | −3.58 | −26.73 | 21.72 | −42.10 | 28.96 | −8.80 |
| D-1299 | 9.97 | −15.14 | 5.99 | −4.68 | 14.33 | −12.03 | −4.77 | −16.17 |
| D-1301 | 42.98 | 8.71 | 10.05 | 11.59 | 18.48 | −7.91 | 1.65 | 0.99 |
| D-1302 | 8.78 | −15.98 | 11.08 | 4.83 | 4.61 | −11.01 | −0.73 | −2.26 |
| D-1303 | 18.39 | 8.99 | 15.05 | 3.34 | 34.38 | 16.39 | 4.95 | 0.93 |
| D-1335 | −4.41 | −57.42 | −7.81 | −12.59 | −2.78 | −53.97 | −5.32 | −38.92 |
| D-1340 | 15.42 | −56.65 | 12.63 | −47.35 | 18.08 | −56.73 | 11.55 | −47.26 |
| D-1342 | −1.34 | −55.68 | 1.60 | −30.81 | −14.13 | −55.74 | 24.66 | −34.02 |
| D-1350 | 12.25 | −46.29 | 16.43 | −17.81 | 8.86 | −45.60 | 11.73 | −15.78 |
| D-1364 | −36.14 | −58.31 | −7.81 | −45.74 | −31.95 | −57.24 | −2.47 | −42.87 |
| D-1365 | −45.46 | −59.21 | 1.08 | −39.04 | −54.43 | −55.49 | −9.26 | −47.65 |
| D-1367 | −2.23 | −49.60 | 27.47 | −0.24 | 0.35 | −55.94 | 15.49 | −40.01 |
| D-1373 | 29.80 | −55.97 | 22.64 | −34.90 | −9.37 | −57.64 | 15.40 | −50.30 |
| D-1376 | 9.37 | −54.03 | 4.61 | −6.55 | −18.48 | −58.89 | 23.74 | −40.26 |
| D-1387 | −15.62 | −60.74 | 12.03 | −24.43 | −22.84 | −59.13 | −0.46 | −55.15 |
| D-1389 | 37.33 | −60.30 | −1.68 | −58.97 | −6.03 | −59.85 | 6.51 | −56.49 |
| D-1390 | −7.09 | −62.69 | 1.94 | −19.96 | 18.08 | −60.28 | 11.92 | −58.45 |
| D-1397 | −17.90 | −62.94 | 10.13 | −56.73 | 25.06 | −60.77 | 4.12 | −56.43 |
| D-1398 | −7.09 | −61.91 | 9.27 | −39.40 | −6.43 | −56.41 | 27.77 | −34.30 |
| D-1399 | −33.81 | −62.45 | 12.59 | −17.06 | 2.08 | −59.75 | 11.14 | −50.83 |
| D-1400 | 46.65 | −59.41 | 13.50 | −36.58 | 16.15 | −59.11 | 11.92 | −48.21 |
| D-1403 | 24.74 | −0.88 | 20.40 | 4.38 | −19.29 | −29.75 | 11.27 | 4.71 |
| D-1405 | −7.78 | −10.82 | 8.24 | −5.29 | 4.30 | −1.20 | −4.03 | −5.98 |
| D-1406 | −3.92 | −9.59 | −1.85 | −8.89 | −5.01 | −9.40 | 23.74 | 15.19 |
| D-1407 | 18.69 | −3.89 | −7.29 | −12.59 | −4.30 | −19.11 | 9.90 | −6.78 |
| D-1408 | 8.73 | −49.20 | −12.98 | −42.77 | −1.47 | −53.33 | 12.19 | −35.80 |
| D-1426 | −6.79 | −61.40 | −12.46 | −51.50 | −4.30 | −59.00 | −19.34 | −56.51 |
| D-1431 | 5.30 | −58.85 | −8.50 | −53.37 | −3.19 | −57.76 | 0.18 | −47.13 |
| D-1432 | −16.11 | −61.98 | −2.72 | −45.35 | −22.53 | −58.60 | 3.76 | −47.92 |
| D-1438 | 7.09 | −61.80 | 23.59 | −55.97 | 3.49 | −58.39 | 21.45 | −54.63 |
| D-1443 | −10.76 | −62.32 | 2.98 | −59.31 | 3.80 | −59.01 | 8.98 | −54.86 |
| D-1452 | −0.79 | −56.32 | 14.27 | −45.83 | −31.70 | −56.68 | 10.91 | −52.19 |
| D-1453 | 12.05 | −56.42 | 31.87 | −26.99 | −32.86 | −57.12 | 13.47 | −56.95 |
| D-1454 | −25.83 | −60.61 | 2.63 | −24.99 | −23.65 | −59.91 | 9.62 | −55.41 |
| D-1455 | 19.58 | −55.42 | −6.34 | −27.92 | 8.46 | −58.89 | 0.27 | −51.97 |
| D-1472 | 29.80 | −55.21 | −2.89 | −22.04 | −13.42 | −58.75 | 21.91 | −52.79 |
| D-1478 | −3.12 | −60.56 | 7.03 | −3.28 | 4.81 | −58.19 | 12.01 | −43.07 |
| D-1479 | 20.38 | −59.07 | −15.14 | −22.23 | −7.95 | −58.41 | 10.08 | −42.61 |
| D-1484 | −6.30 | −62.62 | 9.87 | −39.24 | 13.01 | −58.78 | 3.76 | −51.54 |
| D-1494 | −13.73 | −63.95 | 6.34 | −41.07 | −11.19 | −60.62 | 22.64 | −59.92 |
| D-1495 | 8.28 | −62.15 | 4.70 | −27.22 | 18.89 | −60.38 | 20.16 | −55.68 |
| D-1497 | 26.13 | −59.97 | 4.96 | −58.89 | 0.05 | −60.05 | 14.12 | −58.30 |
| D-1502 | 14.97 | −45.58 | 1.94 | −38.33 | −4.76 | −54.72 | 5.77 | −38.10 |
| D-1505 | −8.28 | −59.54 | −12.25 | −17.83 | −14.08 | −59.50 | 3.02 | −36.43 |
| D-1506 | 8.18 | −57.99 | 20.91 | −9.71 | −2.48 | −58.59 | 2.11 | −41.88 |
| D-1511 | −0.74 | −15.67 | −2.63 | −10.15 | 1.16 | −14.97 | 13.84 | −0.23 |
| D-1516 | 12.05 | −4.94 | −1.08 | 0.63 | 4.51 | 1.35 | −1.19 | −17.05 |
| D-1518 | −4.21 | −26.51 | −13.58 | −8.51 | −4.00 | −3.46 | 13.57 | −3.88 |
| D-1521 | 18.29 | −23.36 | 6.68 | 1.40 | 20.81 | 15.51 | −3.85 | −13.25 |
| D-1536 | 16.31 | −15.47 | 1.25 | 5.23 | 27.70 | −11.54 | 6.14 | 0.40 |
| D-1554 | 13.24 | −13.40 | −4.70 | 0.95 | 6.63 | −32.03 | 3.30 | −0.92 |
| D-1556 | −26.52 | −41.44 | 3.49 | 6.92 | −3.19 | −13.71 | −1.47 | −10.81 |
| D-1572 | 26.62 | −24.09 | 20.31 | 5.52 | 5.62 | −1.00 | 24.01 | 11.58 |
| D-1578 | −4.71 | −44.74 | −12.89 | −14.92 | 2.78 | −23.50 | 5.22 | −5.92 |
| D-1581 | −23.05 | −27.51 | −16.17 | −14.43 | −22.53 | −12.89 | −2.38 | −15.63 |
| D-1623 | −22.46 | −30.62 | −11.69 | −6.55 | −25.27 | −32.19 | 13.47 | 4.71 |
| D-1627 | 12.25 | −23.19 | −4.96 | −29.97 | −10.89 | −38.16 | 1.56 | −25.15 |
| D-1653 | 11.06 | −32.19 | 9.44 | 0.09 | −4.71 | −32.15 | 19.52 | 0.81 |
| D-1656 | 5.60 | −38.39 | 1.51 | −22.78 | −21.42 | −49.42 | 3.94 | −21.36 |
| D-1678 | −32.77 | −50.41 | −16.52 | −23.47 | −15.04 | −44.98 | 5.50 | −6.64 |
| D-1683 | 11.65 | −32.74 | 4.53 | −1.23 | 4.81 | −26.86 | 13.75 | −6.80 |
| D-1686 | 2.63 | −31.87 | −13.15 | −4.49 | 13.42 | −13.30 | 23.37 | −3.19 |
| D-1687 | −1.54 | −38.12 | −0.56 | −8.62 | −17.37 | −40.05 | 21.08 | −7.89 |
| D-1694 | −15.82 | −54.86 | 8.58 | −24.98 | −29.82 | −48.50 | 14.02 | −28.37 |

TABLE 2-continued

In vitro efficacy of Tier 1 ASGR1 siRNA molecules in immunoassay screen

| | Run 1 | | | | Run 2 | | | |
|---|---|---|---|---|---|---|

TABLE 2-continued

In vitro efficacy of Tier 1 ASGR1 siRNA molecules in immunoassay screen

| | Run 1 | | | | Run 2 | | | |
|---|---|---|---|---|---|---|---|---|
| Duplex No. | Cell count 5 nM | Normalized Alexa 488 Mean Intensity 5 nM | Cell count 1.25 nM | Normalized Alexa 488 Mean Intensity 1.25 nM | Cell count 5 nM | Normalized Alexa 488 Mean Intensity 5 nM | Cell count 1.25 nM | Normalized Alexa 488 Mean Intensity 1.25 nM |
| D-2174 | 2.03 | −51.87 | 4.79 | 4.73 | 6.84 | −47.31 | 7.97 | −30.31 |
| D-2192 | 14.43 | −41.72 | 15.48 | −11.07 | 24.96 | −44.47 | 21.91 | −24.19 |
| D-2196 | 1.64 | −52.44 | 14.27 | −0.40 | −34.38 | −55.66 | −0.82 | −47.45 |
| D-2199 | 26.82 | −56.29 | −4.01 | −2.81 | 20.71 | −58.07 | 12.37 | −38.76 |
| D-2200 | 5.01 | −38.18 | 8.50 | 9.77 | 12.51 | −44.01 | 18.42 | −25.19 |
| D-2202 | 5.85 | −5.08 | −2.24 | 1.89 | −1.47 | 6.11 | 1.37 | −0.43 |
| D-2210 | −20.87 | −58.61 | 2.29 | −24.34 | −1.57 | −44.74 | 15.58 | −23.79 |
| D-2224 | 13.34 | −54.07 | 14.70 | −17.77 | 39.54 | −51.64 | 2.57 | −36.75 |
| D-2230 | −23.95 | −40.70 | −2.54 | −5.35 | −10.68 | −6.76 | 20.26 | 15.29 |
| D-2236 | 9.17 | −55.50 | −4.44 | −35.30 | 4.51 | −46.56 | −3.57 | −27.54 |
| D-2238 | 16.01 | −48.75 | −9.79 | −29.17 | 21.42 | −42.21 | 6.14 | −28.27 |
| D-2266 | 8.08 | −14.56 | 3.84 | −18.65 | 6.73 | −28.22 | 6.51 | −12.90 |
| D-2267 | 9.27 | 0.67 | −1.60 | 3.64 | −41.87 | −43.95 | 14.85 | 15.50 |
| D-2294 | 25.63 | −7.76 | 14.01 | 6.68 | −8.66 | −31.02 | 17.78 | 4.99 |
| D-2296 | 16.81 | −28.11 | −1.94 | −17.85 | −13.22 | −41.06 | 17.32 | −11.82 |
| D-2300 | −26.13 | −57.30 | 8.32 | 0.46 | −45.22 | −53.30 | 3.94 | −29.90 |
| D-2301 | −15.72 | −38.46 | 22.38 | 5.62 | −9.87 | −38.50 | −9.07 | −20.00 |
| D-2304 | 14.53 | −53.06 | 4.79 | −16.86 | −20.91 | −58.98 | 15.03 | −42.20 |
| D-2311 | −60.73 | −63.05 | 1.25 | −54.94 | −59.90 | −59.83 | 6.78 | −51.22 |
| D-2322 | 9.07 | −53.47 | −1.60 | −28.61 | −3.70 | −53.94 | 5.32 | −34.29 |
| D-2335 | 2.73 | −59.25 | 7.46 | −44.73 | −3.09 | −57.83 | 2.02 | −37.63 |
| D-2354 | 3.12 | −52.45 | 16.77 | 7.77 | 7.04 | −49.64 | 15.31 | −39.67 |
| D-2357 | 46.55 | −51.86 | 14.45 | −45.90 | 3.39 | −59.31 | 3.85 | −56.37 |
| D-2360 | 22.46 | −57.37 | 24.71 | −13.55 | 19.49 | −56.45 | 19.80 | −34.93 |
| D-2361 | 11.16 | −50.62 | 10.31 | −17.97 | 42.58 | −57.92 | 12.37 | −49.42 |
| D-2362 | 24.54 | −24.39 | 5.22 | 3.25 | 10.08 | −36.37 | 17.14 | −0.36 |
| D-2374 | 32.97 | −24.51 | −9.10 | 1.81 | 13.01 | −36.58 | 9.07 | −25.51 |
| D-2388 | −18.59 | −43.66 | 12.38 | 0.51 | −10.58 | −29.34 | 30.98 | 10.51 |
| D-2399 | −39.22 | −56.10 | −4.18 | −28.95 | −68.10 | −59.66 | −39.60 | −51.94 |
| D-2401 | −30.49 | −59.59 | −1.25 | −11.64 | −40.30 | −57.59 | 10.04 | −34.66 |
| D-2403 | −8.97 | −61.28 | 2.20 | −9.13 | −14.63 | −57.17 | 38.59 | −13.48 |
| D-2412 | 15.62 | 6.15 | 12.89 | 11.91 | 2.18 | −12.33 | 12.10 | −4.72 |
| D-2461 | −19.78 | −56.95 | −6.34 | −54.93 | −35.49 | −57.76 | −7.52 | −49.34 |
| D-2462 | 18.79 | −21.80 | 11.25 | −2.95 | −32.35 | −52.99 | −2.84 | −24.30 |
| D-2465 | 13.83 | −55.08 | 7.89 | −7.64 | 1.97 | −58.56 | 20.90 | −43.55 |
| D-2466 | 28.90 | −49.02 | −7.29 | −8.54 | −17.47 | −57.63 | 17.05 | −43.13 |
| D-2468 | 9.17 | −52.16 | −5.74 | −14.25 | 43.70 | −57.19 | 12.47 | −48.60 |
| D-2475 | −28.90 | −54.23 | −7.12 | −5.24 | −47.75 | −56.37 | 5.04 | −38.94 |
| D-2481 | 12.94 | −55.66 | 3.23 | −12.64 | 3.70 | −54.71 | 18.42 | −28.59 |
| D-2487 | 17.50 | −10.84 | −4.01 | −0.05 | 9.37 | −7.38 | 14.12 | 1.83 |

Of the 211 unmodified siRNA molecules screened in Tier 1, at the 5 nM concentration, about 168 siRNA molecules reduced ASGR1 cell surface expression relative to control cells by at least 30%, about 119 siRNA molecules reduced ASGR1 cell surface expression relative to control cells by at least 50%, and about 30 siRNA molecules reduced ASGR1 cell surface expression relative to control cells by at least 60%. Some of the siRNA molecules exhibited no or marginal reduction in ASGR1 cell surface expression relative to control cells.

A subset of the siRNA molecules from this initial screen of the Tier 1 molecules were selected for further testing in a 10-point dose response format (0.004 nM to 83 nM) in the in vitro anti-ASGR1 immunoassay in Hep3B cells. IC50 values for each of these 55 siRNA molecules were calculated from the dose-response curves and are shown in Table 3 below. Data from two independent transfections of each siRNA molecule (Run 1 and Run 2) are shown. At least 18 of the siRNA molecules had IC50 values of about 0.30 nM or less. Compounds D-1983, D-1098, D-1438, D-1246, and D-1494 were among the most potent with average IC50 values less than 0.15 nM.

TABLE 3

IC50 values determined by immunoassay for select ASGR1 siRNA molecules

| Duplex No. | Run 1 IC50 (nM) | Run 2 IC50 (nM) |
|---|---|---|
| D-1055 | >83.33 | >83.33 |
| D-1082 | 0.72 | 1.10 |
| D-1089 | 0.15 | 0.24 |
| D-1098 | 0.08 | 0.09 |
| D-1168 | 1.98 | 1.74 |
| D-1170 | 0.32 | 0.20 |
| D-1171 | 1.01 | 0.56 |
| D-1173 | 0.64 | 0.23 |
| D-1176 | 1.48 | 0.95 |
| D-1206 | 0.74 | 0.25 |
| D-1235 | 0.58 | 0.35 |
| D-1246 | 0.17 | 0.11 |
| D-1340 | 0.31 | 0.44 |
| D-1364 | 0.51 | 0.72 |
| D-1373 | 0.22 | 0.32 |
| D-1389 | 0.19 | 0.12 |
| D-1397 | 0.47 | 0.08 |
| D-1408 | 0.90 | 0.44 |
| D-1426 | 0.26 | 0.43 |

TABLE 3-continued

IC50 values determined by immunoassay for select ASGR1 siRNA molecules

| Duplex No. | Run 1 IC50 (nM) | Run 2 IC50 (nM) |
|---|---|---|
| D-1431 | 0.41 | 0.54 |
| D-1432 | 3.39 | 3.31 |
| D-1438 | 0.10 | 0.16 |
| D-1443 | 0.53 | 0.28 |
| D-1472 | 0.57 | 0.60 |
| D-1484 | 0.29 | 0.17 |
| D-1494 | 0.21 | 0.07 |
| D-1497 | 1.50 | 0.15 |
| D-1686 | 27.78 | >83.33 |
| D-1708 | 0.66 | 0.56 |
| D-1798 | 0.48 | 0.52 |
| D-1801 | 0.50 | 0.76 |
| D-1811 | 0.73 | 0.57 |
| D-1813 | 0.29 | 0.29 |
| D-1815 | 0.80 | 0.24 |
| D-1824 | 0.39 | 0.33 |
| D-1826 | 1.08 | 0.07 |
| D-1832 | 0.26 | 0.12 |
| D-1981 | 1.33 | 0.46 |
| D-1983 | 0.05 | 0.05 |
| D-1989 | 1.35 | 0.83 |
| D-1999 | 0.23 | 0.14 |
| D-2000 | 0.67 | 0.45 |
| D-2006 | 0.52 | 0.55 |
| D-2045 | 0.14 | 0.21 |
| D-2056 | 0.27 | 0.19 |
| D-2069 | 1.33 | 1.33 |
| D-2122 | 0.80 | 1.41 |
| D-2142 | 2.07 | 1.12 |
| D-2143 | 1.12 | 0.68 |
| D-2311 | 0.56 | 0.46 |
| D-2335 | 0.28 | 0.23 |
| D-2357 | 0.38 | 0.28 |
| D-2361 | 0.75 | 0.70 |
| D-2401 | 0.99 | 0.76 |
| D-2461 | 1.05 | 0.91 |

All of the Tier 2 siRNA molecules, except for 8 siRNA molecules targeting the 5' and 3' ends of the human ASGR1 transcript, were tested in the in vitro anti-ASGR1 immunoassay in Hep3B cells at two different concentrations (1.25 nM and 5 nM). The reduction in ASGR1 cell surface expression relative to expression in cells transfected with non-targeting siRNAs in Hep3B cells for each siRNA molecule is shown in Table 4 below. Cell count measurements are also provided.

TABLE 4

In vitro efficacy of Tier 2 ASGR1 siRNA molecules in immunoassay screen

| Duplex No. | Cell count 5 nM | Normalized Alexa 488 Mean Intensity 5 nM | Cell count 1.25 nM | Normalized Alexa 488 Mean Intensity 1.25 nM |
|---|---|---|---|---|
| D-1000 | −7.89 | −69.66 | 14.36 | −16.59 |
| D-1001 | −37.89 | −69.18 | 2.85 | −24.50 |
| D-1002 | −31.79 | −57.03 | 11.54 | −1.83 |
| D-1003 | −3.36 | 37.23 | 9.55 | −2.29 |
| D-1004 | 1.60 | −59.64 | 8.80 | −8.51 |
| D-1005 | 3.05 | −28.72 | −1.24 | 2.39 |
| D-1006 | −32.96 | −57.28 | −7.05 | −9.66 |
| D-1007 | −27.69 | −70.79 | 14.31 | −3.33 |
| D-1008 | 30.65 | 9.28 | 20.79 | 12.22 |
| D-1009 | −23.35 | −73.69 | 11.67 | −2.29 |
| D-1010 | 35.43 | −55.89 | 3.56 | −22.96 |
| D-1012 | 16.98 | −75.78 | 10.37 | −34.40 |
| D-1013 | 24.10 | 12.20 | 8.33 | 2.11 |
| D-1014 | 7.31 | −65.21 | 12.97 | −6.17 |
| D-1015 | −7.71 | −73.25 | 16.15 | −4.04 |
| D-1016 | −60.21 | −61.66 | 6.81 | 14.15 |
| D-1017 | 11.83 | −56.24 | 4.70 | 2.01 |
| D-1019 | 29.84 | −64.73 | −1.46 | −12.82 |
| D-1020 | 25.65 | −53.00 | −2.67 | −10.04 |
| D-1021 | −26.83 | −75.10 | 2.11 | −12.78 |
| D-1022 | −0.55 | −59.91 | −3.68 | −22.68 |
| D-1023 | −0.29 | 13.64 | 11.80 | 2.03 |
| D-1025 | 27.98 | −1.15 | 7.76 | −2.93 |
| D-1026 | −18.53 | −56.89 | 13.22 | 8.74 |
| D-1027 | 55.59 | −36.50 | 11.10 | 1.38 |
| D-1028 | −32.96 | −19.81 | 5.19 | −0.71 |
| D-1029 | −20.89 | −63.26 | 13.44 | −5.46 |
| D-1030 | 27.16 | −43.18 | 5.36 | −9.83 |
| D-1031 | 6.49 | −13.65 | 23.42 | 2.27 |
| D-1032 | −1.16 | −10.97 | −4.20 | −13.77 |
| D-1033 | −30.24 | −69.98 | −0.58 | −13.92 |
| D-1034 | −28.53 | −23.08 | 9.46 | 3.34 |
| D-1035 | 25.32 | −65.71 | 3.16 | −16.06 |
| D-1037 | −3.94 | −52.11 | 11.55 | −9.25 |
| D-1038 | −7.40 | −57.60 | 16.02 | −6.46 |
| D-1039 | 14.47 | −71.31 | 9.64 | −34.96 |
| D-1040 | −4.57 | −54.21 | 14.10 | −0.10 |
| D-1041 | −11.52 | −69.09 | −6.14 | −14.98 |
| D-1042 | −30.28 | −38.43 | −4.52 | −15.31 |
| D-1043 | 36.88 | −29.24 | 6.55 | −7.92 |
| D-1044 | 2.11 | 33.99 | 18.08 | 14.48 |
| D-1045 | −51.56 | −57.05 | 6.11 | −6.29 |
| D-1046 | −4.10 | −54.90 | 18.23 | 4.76 |
| D-1047 | 2.37 | −61.85 | 10.29 | 5.28 |
| D-1048 | 47.43 | −78.54 | 22.26 | −40.26 |
| D-1049 | −21.19 | −48.21 | 18.33 | 3.60 |
| D-1050 | −48.89 | −66.58 | 2.19 | −5.94 |
| D-1051 | −24.11 | −78.56 | 9.89 | −3.84 |
| D-1052 | 20.98 | −65.51 | −1.22 | −10.60 |
| D-1053 | −24.22 | −33.53 | 16.74 | 0.96 |
| D-1054 | 13.12 | −66.55 | −6.19 | −20.07 |
| D-1055 | −1.47 | −30.04 | 5.24 | −6.10 |
| D-1056 | −5.32 | −74.11 | 21.67 | −19.44 |
| D-1057 | −4.16 | 8.07 | −2.83 | −19.78 |
| D-1058 | 15.98 | −60.00 | 9.56 | −6.36 |
| D-1059 | 48.61 | −77.08 | 1.54 | −3.17 |
| D-1060 | −15.59 | −38.07 | 4.82 | 2.38 |
| D-1061 | −23.58 | −28.91 | 13.89 | −4.03 |
| D-1062 | 6.14 | −17.75 | 38.76 | 11.62 |
| D-1064 | 0.34 | −47.84 | 4.56 | −9.18 |
| D-1065 | −6.79 | −66.80 | 6.78 | −22.67 |
| D-1066 | −65.89 | −80.55 | 2.45 | −7.49 |
| D-1067 | −33.03 | −50.01 | −10.13 | −11.57 |
| D-1068 | 24.92 | 34.77 | 12.70 | −11.13 |
| D-1070 | −2.32 | −77.56 | 4.69 | −41.44 |
| D-1071 | −13.75 | −49.58 | −4.45 | −27.30 |
| D-1072 | −17.16 | −71.02 | 5.27 | −11.02 |
| D-1073 | 3.53 | −70.15 | 0.08 | −20.71 |
| D-1074 | −2.69 | −52.58 | −3.32 | −13.23 |
| D-1075 | −29.75 | −69.26 | 1.62 | 1.87 |
| D-1076 | −19.38 | −47.86 | −12.97 | −23.12 |
| D-1077 | 9.29 | −65.14 | 9.30 | −6.34 |
| D-1078 | −23.33 | −40.07 | 5.01 | −3.70 |
| D-1079 | −42.01 | −63.78 | 0.89 | 0.06 |
| D-1080 | −17.33 | −44.28 | 2.34 | 2.62 |
| D-1081 | 13.97 | −12.08 | 12.60 | 0.04 |
| D-1082 | 31.36 | −61.76 | −6.47 | −45.11 |
| D-1083 | −4.22 | −78.92 | 24.94 | −13.91 |
| D-1084 | −0.24 | −78.23 | 0.59 | −7.50 |
| D-1085 | −11.36 | −44.47 | 0.49 | −16.32 |
| D-1086 | −7.98 | −30.62 | 16.32 | 1.09 |
| D-1087 | −4.69 | −48.31 | 14.94 | −7.65 |
| D-1088 | 34.69 | −75.14 | 3.15 | −32.99 |
| D-1089 | −0.64 | 14.68 | 10.29 | 0.81 |
| D-1090 | 24.33 | −73.19 | 1.58 | −29.18 |
| D-1092 | 15.32 | −38.05 | 22.85 | 7.63 |

TABLE 4-continued

In vitro efficacy of Tier 2 ASGR1 siRNA molecules in immunoassay screen

| Duplex No. | Cell count 5 nM | Normalized Alexa 488 Mean Intensity 5 nM | Cell count 1.25 nM | Normalized Alexa 488 Mean Intensity 1.25 nM |
|---|---|---|---|---|
| D-1093 | 16.98 | −66.40 | 5.15 | −3.92 |
| D-1094 | −28.11 | −76.79 | 9.05 | −12.11 |
| D-1095 | −62.01 | −80.60 | −6.17 | −18.12 |
| D-1096 | 29.08 | −59.93 | 22.01 | −14.91 |
| D-1097 | −3.49 | −57.96 | 13.47 | −9.93 |
| D-1098 | −4.13 | −77.54 | 18.58 | 11.13 |
| D-1099 | 1.50 | −37.43 | 13.86 | −9.51 |
| D-1100 | 36.33 | −34.40 | −4.77 | −12.29 |
| D-1101 | 18.17 | −67.20 | −3.35 | −12.05 |
| D-1102 | −32.57 | −36.16 | 7.11 | −2.90 |
| D-1103 | 14.19 | −66.58 | 2.19 | −4.37 |
| D-1104 | −26.08 | −71.40 | −0.66 | −21.29 |
| D-1105 | 26.73 | −18.96 | 3.08 | −10.81 |
| D-1106 | 4.76 | −60.72 | 7.37 | 6.57 |
| D-1107 | 0.97 | −31.43 | 9.38 | −3.31 |
| D-1108 | −8.06 | −74.96 | 3.16 | −35.88 |
| D-1109 | 16.36 | −42.30 | 4.53 | −4.72 |
| D-1110 | 12.49 | −25.10 | 24.01 | 5.26 |
| D-1111 | 30.30 | −7.13 | 2.99 | −8.86 |
| D-1112 | −13.01 | −16.74 | 27.80 | 11.70 |
| D-1113 | 6.34 | −59.24 | 10.21 | −0.62 |
| D-1114 | −24.13 | −24.51 | 9.04 | −7.34 |
| D-1115 | −24.09 | −75.18 | −10.45 | −43.54 |
| D-1116 | −15.10 | −30.34 | 12.21 | −0.66 |
| D-1117 | 17.76 | 9.45 | 4.90 | −8.17 |
| D-1118 | 2.98 | −22.01 | 21.22 | 1.82 |
| D-1119 | −14.42 | −29.69 | −4.61 | −9.83 |
| D-1120 | −8.07 | −59.22 | 2.09 | −18.67 |
| D-1121 | 1.37 | −38.92 | 0.00 | −18.03 |
| D-1122 | −25.60 | −13.63 | −16.07 | −5.83 |
| D-1123 | −23.76 | −13.41 | 18.49 | −0.36 |
| D-1124 | 29.36 | −39.05 | 30.71 | 8.55 |
| D-1125 | 15.34 | −60.37 | −1.83 | −18.69 |
| D-1126 | 8.35 | −20.20 | 11.35 | 14.70 |
| D-1127 | 13.94 | −56.41 | 4.37 | −23.47 |
| D-1128 | −9.29 | −43.79 | 11.18 | 7.39 |
| D-1129 | −36.45 | −70.33 | 7.05 | 19.91 |
| D-1130 | 7.87 | −58.39 | −6.32 | −12.47 |
| D-1131 | −4.69 | −60.73 | 11.29 | −12.42 |
| D-1132 | 13.53 | 3.34 | 20.18 | 10.44 |
| D-1133 | 6.11 | −32.84 | 10.06 | −9.99 |
| D-1134 | −8.48 | −55.96 | 5.75 | −15.23 |
| D-1136 | −23.95 | −25.01 | 15.68 | −0.43 |
| D-1137 | −31.73 | −70.89 | 5.75 | −7.02 |
| D-1138 | 25.27 | 3.96 | 10.59 | −5.05 |
| D-1139 | 36.30 | 16.88 | 9.30 | 0.56 |
| D-1140 | 38.80 | −11.18 | 8.96 | −9.00 |
| D-1141 | −9.08 | −59.67 | 1.92 | −3.78 |
| D-1142 | −2.57 | −29.79 | 4.60 | −9.26 |
| D-1143 | 10.00 | −23.14 | 18.41 | 3.98 |
| D-1144 | −22.41 | −67.81 | 5.16 | −4.68 |
| D-1145 | −11.01 | −39.40 | 14.98 | −5.93 |
| D-1146 | 20.61 | −60.09 | 5.83 | −14.30 |
| D-1148 | −32.46 | −42.55 | 24.90 | 13.98 |
| D-1149 | −9.39 | −20.73 | −4.28 | −13.98 |
| D-1150 | 16.11 | −22.00 | 7.88 | −9.56 |
| D-1152 | −54.17 | −60.99 | 7.05 | −4.58 |
| D-1153 | 11.52 | −30.76 | −12.21 | −20.90 |
| D-1154 | −0.73 | −46.96 | 6.97 | −6.28 |
| D-1155 | 7.26 | −13.95 | 3.23 | −13.24 |
| D-1156 | 3.05 | −46.25 | 13.69 | −5.66 |
| D-1157 | 12.93 | −59.47 | 16.23 | −11.64 |
| D-1159 | −29.47 | −55.55 | 1.70 | −4.00 |
| D-1160 | −0.42 | −73.42 | −0.81 | −10.76 |
| D-1161 | 18.25 | −23.94 | 6.32 | 6.22 |
| D-1163 | −44.43 | −63.99 | 13.02 | −0.59 |
| D-1164 | −7.43 | −49.38 | 8.03 | −6.32 |
| D-1168 | 1.65 | −40.89 | 4.12 | −19.65 |
| D-1169 | −19.55 | −49.51 | 13.74 | −5.68 |
| D-1170 | −26.61 | −71.74 | 7.70 | −2.54 |
| D-1171 | 4.11 | −75.01 | 22.41 | 11.35 |
| D-1173 | 45.33 | −49.69 | 7.69 | −11.52 |
| D-1176 | −14.04 | 39.10 | 14.23 | 10.32 |
| D-1177 | −25.04 | −68.88 | 3.57 | −5.82 |
| D-1178 | 18.05 | −75.84 | 9.63 | −21.29 |
| D-1179 | 9.45 | −28.67 | 5.52 | 1.22 |
| D-1180 | −11.55 | 0.73 | −1.94 | −1.98 |
| D-1181 | −30.55 | −78.57 | 15.31 | −17.01 |
| D-1182 | −40.88 | −57.42 | 9.63 | −11.33 |
| D-1183 | 24.63 | −66.53 | 5.98 | −10.91 |
| D-1184 | −13.11 | −33.62 | 8.80 | −6.36 |
| D-1185 | −16.61 | −39.82 | 12.97 | 5.82 |
| D-1186 | 19.94 | −59.27 | 9.32 | −5.26 |
| D-1187 | −0.73 | −68.89 | −3.98 | −15.07 |
| D-1188 | −32.58 | −53.36 | −10.13 | −28.19 |
| D-1189 | −11.28 | −72.46 | 8.12 | −12.36 |
| D-1190 | −13.36 | −51.18 | 6.31 | −13.35 |
| D-1191 | −18.43 | −12.80 | 8.62 | −7.05 |
| D-1192 | 5.78 | −70.90 | 11.63 | −38.66 |
| D-1193 | −12.63 | −39.72 | 13.11 | −2.18 |
| D-1194 | −7.12 | 59.76 | 23.34 | 19.24 |
| D-1195 | −39.18 | −71.13 | 0.73 | −0.80 |
| D-1196 | 19.11 | 3.83 | 20.58 | 7.12 |
| D-1197 | −3.58 | −53.14 | 10.96 | −4.07 |
| D-1198 | 11.37 | −60.62 | 44.32 | 7.61 |
| D-1199 | 2.66 | −40.94 | −10.62 | −20.63 |
| D-1200 | −31.07 | −78.56 | 2.19 | −15.79 |
| D-1201 | −8.03 | −18.56 | 9.05 | 3.62 |
| D-1202 | 6.39 | 19.18 | 11.88 | 10.69 |
| D-1203 | −23.94 | −38.26 | 11.97 | −7.76 |
| D-1204 | 18.53 | −34.62 | 14.06 | −0.10 |
| D-1205 | 51.91 | −39.17 | −3.16 | −17.83 |
| D-1206 | −37.20 | −73.16 | −3.16 | −20.83 |
| D-1207 | −45.60 | −78.35 | 4.10 | −17.84 |
| D-1208 | 17.42 | −61.26 | 3.15 | −27.63 |
| D-1209 | 0.09 | −22.29 | 3.77 | 1.55 |
| D-1210 | −7.52 | −0.01 | 7.11 | −3.27 |
| D-1212 | −25.06 | −80.96 | −10.57 | −28.32 |
| D-1213 | −16.69 | −70.97 | −1.58 | −20.96 |
| D-1214 | 19.94 | −18.87 | −14.23 | −21.87 |
| D-1215 | −3.19 | −64.93 | 12.37 | −10.03 |
| D-1216 | −20.89 | −56.88 | 5.19 | −8.45 |
| D-1217 | −4.76 | −59.77 | −0.32 | 0.60 |
| D-1218 | 8.81 | −1.56 | 1.67 | −13.50 |
| D-1219 | 8.72 | −15.45 | 5.43 | 4.40 |
| D-1220 | −3.92 | −54.00 | 10.62 | −3.14 |
| D-1221 | −9.45 | −78.87 | 25.02 | −19.76 |
| D-1222 | 24.49 | 16.25 | 9.14 | −7.22 |
| D-1223 | −4.11 | −38.73 | 16.18 | 3.39 |
| D-1224 | 5.78 | −63.52 | 11.05 | −0.39 |
| D-1225 | −27.52 | −39.12 | 12.80 | −6.49 |
| D-1226 | 25.32 | −71.53 | 3.43 | −7.69 |
| D-1227 | −2.40 | −60.87 | 22.20 | 3.16 |
| D-1228 | 20.18 | −11.50 | 25.69 | 15.83 |
| D-1229 | −21.59 | −40.96 | 7.68 | −3.08 |
| D-1230 | −6.72 | −60.01 | 8.80 | −12.19 |
| D-1231 | −11.10 | −17.77 | 11.88 | −0.38 |
| D-1232 | −23.04 | −56.57 | 4.37 | −16.21 |
| D-1233 | −46.59 | −69.92 | 4.90 | −24.43 |
| D-1235 | 6.78 | −71.94 | 8.16 | −14.27 |
| D-1236 | −8.53 | −53.49 | 23.18 | 1.28 |
| D-1238 | 31.17 | −33.38 | 1.70 | −12.57 |
| D-1239 | 15.59 | −59.21 | −6.06 | −21.61 |
| D-1240 | 14.47 | −42.60 | 4.23 | −12.99 |
| D-1241 | −3.73 | −15.54 | 6.14 | −4.81 |
| D-1242 | −27.39 | −44.26 | 11.51 | 12.06 |
| D-1243 | 26.82 | −64.75 | 7.28 | −30.55 |
| D-1244 | −36.97 | −53.39 | −8.20 | −18.44 |
| D-1245 | 13.97 | −59.19 | 6.09 | −5.81 |
| D-1246 | 12.21 | 13.16 | −1.62 | −24.75 |
| D-1247 | −12.88 | −32.06 | 3.88 | −6.32 |
| D-1248 | −38.80 | −68.71 | 16.29 | 12.31 |
| D-1249 | −1.75 | 6.92 | 14.79 | −13.93 |
| D-1251 | 30.27 | −79.34 | 7.61 | −20.01 |

TABLE 4-continued

In vitro efficacy of Tier 2 ASGR1 siRNA molecules in immunoassay screen

| Duplex No. | Cell count 5 nM | Normalized Alexa 488 Mean Intensity 5 nM | Cell count 1.25 nM | Normalized Alexa 488 Mean Intensity 1.25 nM |
|---|---|---|---|---|
| D-1252 | 2.23 | −50.19 | 4.37 | −3.52 |
| D-1253 | −32.85 | −29.67 | 2.99 | 2.33 |
| D-1254 | −36.45 | −76.52 | 8.02 | −21.55 |
| D-1255 | −3.39 | −64.64 | −4.77 | −14.70 |
| D-1256 | 1.01 | −3.30 | 25.61 | 14.58 |
| D-1258 | −49.01 | −54.26 | 4.65 | −6.34 |
| D-1259 | −21.83 | −49.68 | 9.72 | −2.72 |
| D-1260 | 23.21 | −65.48 | 8.03 | −4.15 |
| D-1261 | −31.64 | −57.04 | −9.89 | −13.26 |
| D-1262 | −29.72 | −66.74 | −5.61 | 15.96 |
| D-1263 | −8.33 | −65.33 | 0.08 | −11.83 |
| D-1264 | 36.01 | −20.16 | 4.61 | −14.46 |
| D-1265 | −1.65 | −51.45 | −3.48 | −6.13 |
| D-1266 | −13.01 | −19.17 | −5.06 | −8.27 |
| D-1267 | −5.05 | −31.71 | 11.97 | −0.60 |
| D-1268 | 1.11 | 10.61 | 0.33 | −5.81 |
| D-1269 | −5.56 | −53.51 | 10.62 | −3.13 |
| D-1270 | 1.10 | −60.09 | 17.57 | −2.00 |
| D-1271 | −5.05 | −68.78 | −0.50 | −21.76 |
| D-1272 | −14.37 | −50.90 | −1.83 | −18.13 |
| D-1273 | −31.36 | −62.83 | 15.04 | −1.17 |
| D-1274 | −7.69 | −21.09 | 9.88 | −0.30 |
| D-1275 | 25.07 | −72.64 | 5.58 | −25.02 |
| D-1276 | −4.59 | −35.87 | −3.35 | −11.79 |
| D-1277 | 46.09 | −35.72 | −3.63 | −25.23 |
| D-1278 | 8.53 | −70.41 | 14.59 | −19.50 |
| D-1279 | 5.96 | −4.96 | 22.09 | 28.38 |
| D-1280 | −14.29 | −58.65 | 7.86 | −3.32 |
| D-1281 | 10.07 | −32.98 | 8.49 | 0.81 |
| D-1282 | −28.56 | −74.04 | −3.80 | −35.39 |
| D-1283 | −18.30 | −34.79 | 9.14 | 2.84 |
| D-1284 | −12.11 | −36.83 | 11.05 | 4.28 |
| D-1287 | 11.71 | −21.34 | −12.29 | −28.09 |
| D-1290 | −2.13 | −78.34 | −3.56 | −11.58 |
| D-1292 | −23.43 | −28.70 | −0.57 | −16.42 |
| D-1295 | 25.46 | −57.29 | 15.12 | −1.18 |
| D-1297 | 3.21 | −63.31 | 25.77 | 22.14 |
| D-1298 | −3.92 | −68.03 | −9.71 | −34.14 |
| D-1300 | −10.33 | −49.32 | 0.97 | 2.06 |
| D-1304 | 21.30 | −10.48 | −1.29 | −11.82 |
| D-1305 | 41.65 | 13.01 | 8.80 | −1.54 |
| D-1306 | 29.33 | −7.63 | 8.81 | −6.33 |
| D-1307 | 22.31 | −29.34 | −1.52 | −13.70 |
| D-1308 | 15.60 | −20.06 | 7.53 | −4.85 |
| D-1309 | −14.33 | −52.52 | 16.98 | −9.89 |
| D-1310 | −6.36 | −76.66 | 2.35 | −10.23 |
| D-1311 | 14.29 | −65.01 | −12.32 | −29.59 |
| D-1312 | −8.48 | −79.39 | −0.42 | −14.88 |
| D-1313 | −44.04 | −74.66 | 0.67 | −4.61 |
| D-1314 | −11.91 | −43.05 | 10.02 | −5.56 |
| D-1315 | 8.16 | −46.22 | −0.32 | 2.27 |
| D-1316 | 17.17 | 27.34 | −1.49 | −3.64 |
| D-1317 | −2.23 | −55.09 | 5.58 | −11.09 |
| D-1318 | 11.27 | −47.32 | 18.80 | −7.48 |
| D-1319 | 14.66 | −25.03 | 16.29 | 13.59 |
| D-1320 | 19.79 | −0.18 | 8.88 | −7.73 |
| D-1321 | 9.10 | −76.11 | 17.02 | −0.59 |
| D-1322 | −44.56 | −69.34 | 3.57 | −13.82 |
| D-1323 | 28.21 | −15.42 | 0.41 | −11.61 |
| D-1324 | 21.72 | −62.51 | −10.04 | −6.03 |
| D-1325 | 18.72 | 0.07 | 6.16 | 4.25 |
| D-1326 | −4.10 | −72.25 | −19.37 | −33.56 |
| D-1327 | 16.07 | −68.74 | 2.99 | −16.27 |
| D-1328 | 20.37 | −69.18 | −2.32 | −18.28 |
| D-1329 | −25.32 | −44.99 | −3.16 | 3.98 |
| D-1330 | −16.33 | −63.82 | −5.69 | −16.83 |
| D-1331 | 0.99 | −35.15 | 11.59 | −7.43 |
| D-1332 | −15.23 | −53.20 | 23.43 | 7.37 |
| D-1333 | −11.93 | −39.12 | −2.27 | −4.03 |
| D-1334 | −47.27 | −65.62 | 9.21 | −3.59 |
| D-1336 | 3.44 | −18.99 | 12.97 | 3.86 |
| D-1337 | 4.67 | −67.99 | 4.05 | −14.59 |
| D-1338 | 10.50 | −20.32 | −13.20 | −27.03 |
| D-1339 | 10.45 | −57.10 | 18.11 | −5.50 |
| D-1340 | 7.50 | −75.18 | −11.35 | −51.99 |
| D-1341 | −14.13 | −42.79 | 7.28 | −2.05 |
| D-1343 | 32.45 | −74.74 | 25.44 | −8.83 |
| D-1344 | 21.49 | −79.31 | 8.57 | −41.53 |
| D-1345 | 5.56 | −71.98 | 4.40 | −14.59 |
| D-1346 | 10.84 | −47.45 | −2.43 | −21.79 |
| D-1347 | 11.85 | −38.12 | 6.72 | −16.62 |
| D-1348 | −4.77 | −76.11 | −1.17 | −20.86 |
| D-1349 | −36.51 | −61.19 | 10.46 | 11.03 |
| D-1351 | −15.32 | −73.27 | 4.78 | −8.76 |
| D-1352 | 10.36 | −63.16 | 3.64 | −5.33 |
| D-1353 | 1.21 | −8.18 | 5.23 | −10.04 |
| D-1354 | 3.34 | −75.94 | 4.23 | −15.74 |
| D-1355 | 7.71 | 11.27 | 19.92 | 11.87 |
| D-1356 | −10.85 | −63.81 | 6.34 | 0.13 |
| D-1357 | 1.31 | −37.05 | −14.02 | −16.27 |
| D-1358 | 24.49 | 41.10 | 28.13 | 20.76 |
| D-1359 | 5.56 | −23.75 | 13.20 | −2.77 |
| D-1360 | 17.08 | 37.58 | 1.08 | −11.99 |
| D-1361 | −22.77 | −47.82 | 7.21 | −9.44 |
| D-1362 | 19.55 | −59.93 | 8.97 | −23.28 |
| D-1363 | −51.44 | −77.04 | 7.78 | −22.46 |
| D-1364 | 23.06 | −10.37 | 9.40 | −4.87 |
| D-1366 | −9.36 | −51.45 | 5.94 | 6.52 |
| D-1368 | −2.29 | −52.35 | 11.55 | −12.22 |
| D-1369 | −9.85 | −46.01 | −7.70 | −10.96 |
| D-1370 | −41.93 | −78.44 | 12.97 | −28.38 |
| D-1371 | −17.16 | −36.27 | 4.02 | −4.25 |
| D-1372 | −19.19 | −63.22 | 10.94 | 7.71 |
| D-1373 | 22.27 | −76.68 | 0.97 | −24.18 |
| D-1374 | −24.95 | −73.67 | 8.54 | −38.43 |
| D-1375 | −38.52 | −63.20 | 2.67 | −9.04 |
| D-1377 | −59.82 | −77.46 | 9.62 | −16.34 |
| D-1378 | 17.43 | −27.46 | 0.08 | −1.36 |
| D-1379 | 39.59 | −77.99 | 8.65 | −21.47 |
| D-1380 | 16.50 | −68.50 | −2.57 | −24.69 |
| D-1381 | 5.13 | −34.48 | 0.49 | −0.75 |
| D-1382 | −21.97 | −80.36 | 12.13 | −23.38 |
| D-1383 | −4.29 | −46.09 | 16.86 | 1.03 |
| D-1384 | 1.74 | −78.01 | 14.64 | −24.12 |
| D-1385 | −26.66 | −15.55 | 9.21 | 4.44 |
| D-1386 | −2.76 | −22.47 | −9.79 | −16.76 |
| D-1388 | 11.93 | −28.38 | 16.90 | 18.95 |
| D-1389 | −35.23 | −75.62 | 13.47 | 3.46 |
| D-1391 | −9.54 | −55.57 | 1.76 | 8.01 |
| D-1392 | −25.60 | −69.12 | −6.44 | −31.51 |
| D-1393 | 4.95 | −72.52 | 4.21 | 0.75 |
| D-1394 | 7.16 | −77.18 | 8.33 | −7.38 |
| D-1395 | 30.60 | −72.67 | 3.81 | −29.55 |
| D-1396 | −7.43 | −77.70 | 2.43 | −28.95 |
| D-1397 | 25.07 | −80.00 | 5.34 | −32.68 |
| D-1401 | 0.05 | 6.64 | −11.54 | −12.09 |
| D-1402 | −14.85 | −66.16 | 0.32 | −2.45 |
| D-1404 | 1.69 | −41.85 | 17.51 | 0.44 |
| D-1408 | 32.66 | −74.78 | 5.23 | −9.30 |
| D-1409 | −10.30 | −74.45 | −1.58 | −32.92 |
| D-1410 | −37.77 | −55.14 | 9.16 | 4.08 |
| D-1411 | −9.71 | −61.25 | 5.83 | −11.94 |
| D-1412 | −4.40 | −62.34 | 15.06 | 1.14 |
| D-1413 | −38.99 | −26.13 | 8.91 | 13.59 |
| D-1414 | 0.68 | −48.38 | 11.08 | −5.56 |
| D-1415 | 30.11 | −79.94 | 14.79 | −8.31 |
| D-1416 | 9.00 | −72.55 | −8.25 | −27.91 |
| D-1417 | 20.52 | −1.74 | 14.23 | 4.17 |
| D-1418 | −23.30 | −66.73 | 15.23 | −0.48 |
| D-1419 | 9.36 | −78.21 | 13.31 | −33.52 |
| D-1420 | −25.30 | −63.31 | −10.54 | −25.54 |
| D-1421 | −36.82 | −71.74 | −7.14 | −31.17 |
| D-1422 | −1.31 | −72.73 | 0.50 | −31.24 |
| D-1423 | 6.97 | −32.14 | 5.77 | −0.11 |

TABLE 4-continued

In vitro efficacy of Tier 2 ASGR1 siRNA molecules in immunoassay screen

| Duplex No. | Cell count 5 nM | Normalized Alexa 488 Mean Intensity 5 nM | Cell count 1.25 nM | Normalized Alexa 488 Mean Intensity 1.25 nM |
|---|---|---|---|---|
| D-1424 | −0.05 | −25.55 | 3.32 | −13.94 |
| D-1425 | 14.42 | −32.00 | −3.96 | −15.93 |
| D-1426 | −10.30 | −22.92 | 13.20 | 2.02 |
| D-1427 | −8.53 | −61.49 | 11.51 | −10.59 |
| D-1428 | 19.28 | −18.07 | 5.43 | −4.47 |
| D-1429 | 5.81 | −78.39 | 3.48 | −41.33 |
| D-1430 | 9.87 | −77.50 | −2.26 | −28.08 |
| D-1431 | −20.64 | −79.16 | 2.76 | −35.67 |
| D-1432 | −12.59 | −48.84 | 7.21 | −14.06 |
| D-1433 | −18.88 | −77.44 | −0.49 | −19.75 |
| D-1434 | 30.88 | −31.72 | 25.22 | 7.46 |
| D-1435 | 3.97 | −79.61 | 2.51 | −31.91 |
| D-1436 | 8.08 | −71.76 | −1.08 | −28.30 |
| D-1437 | −17.56 | −72.82 | 15.27 | 8.76 |
| D-1438 | −13.50 | −49.08 | 1.49 | −14.23 |
| D-1439 | 21.43 | −63.70 | 17.18 | −0.95 |
| D-1440 | −0.52 | −65.90 | 5.51 | −21.92 |
| D-1441 | 0.09 | −38.28 | 3.85 | −9.17 |
| D-1442 | 2.66 | −55.33 | −3.43 | −26.16 |
| D-1443 | −24.24 | −30.45 | 11.54 | −0.89 |
| D-1444 | 33.58 | −65.83 | 24.85 | −0.39 |
| D-1445 | −22.79 | −16.47 | 14.20 | −7.26 |
| D-1446 | 22.30 | −16.81 | 8.46 | −8.89 |
| D-1447 | 6.18 | −68.19 | 16.29 | −11.29 |
| D-1448 | 4.01 | −49.66 | 1.54 | −7.00 |
| D-1449 | −40.41 | −15.22 | 3.08 | −10.87 |
| D-1450 | −0.77 | −77.98 | 9.78 | −23.68 |
| D-1451 | −6.58 | −69.35 | 20.12 | −8.13 |
| D-1456 | −16.75 | −79.94 | 2.10 | −14.80 |
| D-1457 | −17.33 | −80.91 | 3.56 | −39.89 |
| D-1458 | 26.04 | −29.22 | 8.57 | −4.40 |
| D-1459 | −12.84 | −76.97 | 9.47 | −15.64 |
| D-1460 | −3.29 | −76.01 | −4.45 | −25.68 |
| D-1461 | −5.61 | −77.92 | −1.70 | −19.63 |
| D-1462 | 2.08 | −63.16 | −6.72 | −26.68 |
| D-1463 | −16.61 | −67.89 | 1.09 | 2.56 |
| D-1464 | −8.48 | −54.92 | 8.11 | −14.13 |
| D-1465 | 5.76 | −71.09 | 18.59 | 0.96 |
| D-1466 | 20.46 | −37.62 | 23.18 | −2.68 |
| D-1467 | 20.32 | −13.04 | −17.34 | −15.71 |
| D-1468 | 31.45 | −64.41 | −2.19 | −4.79 |
| D-1469 | 12.68 | 5.48 | −7.28 | −20.26 |
| D-1470 | 6.92 | −66.88 | 9.38 | −12.70 |
| D-1471 | −22.22 | −74.37 | 13.02 | −13.21 |
| D-1472 | −11.81 | −79.47 | 15.36 | −19.74 |
| D-1473 | −38.46 | −72.40 | −0.17 | −21.43 |
| D-1474 | 2.97 | −57.92 | −5.19 | −16.96 |
| D-1475 | −16.93 | −44.54 | 3.65 | 2.15 |
| D-1476 | −5.89 | −52.67 | 12.80 | −3.85 |
| D-1477 | −17.89 | −60.62 | −3.68 | −2.20 |
| D-1480 | 28.79 | 10.79 | −3.24 | −16.12 |
| D-1481 | 6.70 | −41.49 | 3.35 | −21.34 |
| D-1482 | 7.43 | −19.68 | 17.91 | 6.02 |
| D-1483 | 1.98 | −21.91 | 4.90 | −5.20 |
| D-1484 | −16.51 | −55.79 | 1.51 | 6.85 |
| D-1485 | −36.43 | −80.11 | 9.81 | −11.66 |
| D-1486 | 5.42 | −62.97 | 5.50 | −13.09 |
| D-1487 | 10.89 | −23.86 | −5.81 | −11.30 |
| D-1488 | −14.71 | −68.13 | 6.06 | −5.50 |
| D-1489 | −21.55 | −76.48 | −5.83 | −18.03 |
| D-1490 | 26.04 | −80.46 | 0.57 | −46.23 |
| D-1491 | 32.72 | −80.10 | 1.78 | −26.10 |
| D-1492 | 39.08 | −37.64 | 6.69 | 4.14 |
| D-1493 | 3.54 | −74.86 | 14.02 | −7.60 |
| D-1494 | −19.75 | −43.37 | 20.10 | 2.38 |
| D-1496 | −16.08 | −70.55 | 4.54 | −21.74 |
| D-1497 | 32.26 | −81.52 | 17.58 | −27.07 |
| D-1498 | 12.11 | −40.01 | 51.46 | 25.60 |
| D-1499 | −24.39 | −79.00 | 2.34 | 4.18 |
| D-1500 | −51.56 | −70.59 | 5.02 | −16.85 |
| D-1501 | 46.47 | −65.12 | −19.40 | −28.47 |
| D-1503 | −31.92 | −69.56 | 9.89 | −10.48 |
| D-1504 | 5.50 | −37.04 | 22.85 | 5.61 |
| D-1507 | 8.48 | −55.73 | 23.50 | −8.71 |
| D-1508 | −11.65 | −68.55 | 12.47 | −16.00 |
| D-1509 | −17.76 | −55.16 | 2.07 | −15.48 |
| D-1510 | −4.36 | −29.45 | 7.68 | −3.23 |
| D-1512 | 0.33 | −33.83 | 6.40 | 5.03 |
| D-1513 | −40.09 | −64.18 | 17.24 | −2.88 |
| D-1514 | −19.65 | −33.00 | 1.86 | −10.55 |
| D-1515 | −24.63 | −55.52 | 3.73 | 0.05 |
| D-1517 | −47.61 | −74.57 | 8.95 | −9.97 |
| D-1519 | 11.56 | −29.26 | −12.37 | −18.89 |
| D-1520 | 32.24 | 3.14 | 15.60 | −0.57 |
| D-1522 | 32.14 | 8.88 | 0.97 | −13.70 |
| D-1523 | −7.43 | −50.43 | −1.00 | −11.45 |
| D-1524 | 15.49 | −8.69 | 2.02 | 0.13 |
| D-1525 | −22.79 | −63.32 | 13.36 | 7.28 |
| D-1526 | 10.45 | −12.02 | −9.30 | −17.56 |
| D-1527 | −7.16 | −39.49 | 14.64 | 10.43 |
| D-1528 | 30.78 | 16.18 | −8.65 | −26.51 |
| D-1529 | 5.41 | −34.44 | 5.52 | 9.61 |
| D-1530 | 23.04 | −14.77 | 2.10 | −12.78 |
| D-1531 | 36.53 | −1.44 | 0.50 | −11.53 |
| D-1532 | −11.19 | −22.94 | 18.16 | 2.41 |
| D-1533 | 11.38 | −70.75 | 7.78 | −6.32 |
| D-1541 | −3.76 | −50.19 | 30.21 | 23.94 |
| D-1542 | 4.74 | −17.47 | 9.54 | 1.27 |
| D-1543 | 11.93 | −76.40 | 7.70 | −42.72 |
| D-1544 | −42.33 | −52.93 | 14.69 | −0.38 |
| D-1545 | −9.67 | −41.93 | 4.13 | −9.45 |
| D-1546 | −14.76 | −71.93 | 9.54 | −7.00 |
| D-1547 | −45.14 | −63.59 | 10.29 | −7.72 |
| D-1548 | 7.53 | −32.51 | −6.85 | −8.07 |
| D-1549 | 12.78 | −59.45 | 15.20 | −24.86 |
| D-1550 | 5.96 | −73.04 | 23.10 | −3.15 |
| D-1551 | −3.17 | −50.57 | −4.48 | −10.38 |
| D-1552 | 17.08 | −3.57 | 3.49 | −13.28 |
| D-1553 | −37.67 | −70.41 | −11.02 | −23.50 |
| D-1555 | −19.85 | −47.96 | 1.54 | −8.57 |
| D-1557 | −22.96 | −65.81 | 4.46 | −6.26 |
| D-1558 | 15.05 | −10.38 | 16.99 | 13.12 |
| D-1559 | −11.13 | −11.60 | 10.59 | −5.72 |
| D-1560 | −14.95 | −70.17 | 10.29 | −4.46 |
| D-1561 | −2.81 | −53.50 | −3.31 | −23.23 |
| D-1562 | −0.90 | −70.55 | 8.91 | −2.19 |
| D-1563 | 6.74 | −36.12 | −1.70 | −11.00 |
| D-1564 | −0.33 | −76.38 | 9.89 | −9.36 |
| D-1565 | 11.74 | −70.09 | 17.57 | 3.84 |
| D-1566 | −19.26 | −36.08 | 4.12 | −20.01 |
| D-1567 | −36.21 | −26.16 | 16.33 | 8.05 |
| D-1568 | −22.17 | −29.62 | 8.89 | −0.71 |
| D-1569 | 21.63 | −2.09 | 10.46 | −5.42 |
| D-1570 | 22.11 | −76.43 | 14.14 | −32.88 |
| D-1571 | −0.82 | −37.92 | 5.89 | −14.85 |
| D-1573 | −10.18 | −64.73 | 4.44 | −1.95 |
| D-1574 | −2.61 | −35.69 | 2.26 | −15.60 |
| D-1575 | 15.97 | −5.44 | −9.22 | −15.32 |
| D-1576 | −10.11 | −49.40 | −16.68 | −16.01 |
| D-1577 | −36.79 | −70.90 | 22.18 | 3.36 |
| D-1579 | −13.84 | −42.68 | 7.44 | −10.53 |
| D-1580 | −16.15 | −0.78 | 11.21 | 1.18 |
| D-1582 | −29.33 | −70.31 | 4.61 | −9.18 |
| D-1583 | −3.91 | −72.50 | −5.83 | −22.00 |
| D-1584 | −17.49 | −69.74 | 14.91 | −4.97 |
| D-1585 | 29.70 | −51.61 | 6.85 | −9.20 |
| D-1586 | −10.36 | −24.80 | −3.64 | −14.72 |
| D-1587 | −12.24 | −16.84 | −4.32 | −14.95 |
| D-1588 | 0.39 | −1.95 | 13.34 | −2.91 |
| D-1589 | 40.88 | 0.52 | 14.26 | 6.47 |
| D-1590 | −5.61 | 22.64 | −0.97 | −7.11 |
| D-1591 | 2.31 | −30.67 | −3.48 | −13.93 |
| D-1592 | −19.75 | −38.53 | 3.55 | −6.58 |
| D-1593 | 19.01 | 6.07 | 19.17 | 16.66 |

TABLE 4-continued

In vitro efficacy of Tier 2 ASGR1 siRNA molecules in immunoassay screen

| Duplex No. | Cell count 5 nM | Normalized Alexa 488 Mean Intensity 5 nM | Cell count 1.25 nM | Normalized Alexa 488 Mean Intensity 1.25 nM |
|---|---|---|---|---|
| D-1594 | −17.20 | −57.14 | −1.44 | −15.06 |
| D-1595 | −15.97 | −57.16 | 19.00 | 7.35 |
| D-1596 | −15.98 | −42.84 | 9.16 | 8.17 |
| D-1597 | 1.66 | −71.11 | 7.27 | −23.62 |
| D-1598 | −4.22 | −63.19 | 7.03 | −6.96 |
| D-1599 | 11.04 | −39.72 | −1.13 | −20.46 |
| D-1600 | 17.62 | −38.11 | 9.86 | −16.81 |
| D-1601 | 35.77 | −77.17 | 11.75 | −26.16 |
| D-1602 | −33.82 | −69.95 | 5.89 | −13.32 |
| D-1603 | 31.45 | −71.55 | −2.35 | −30.03 |
| D-1604 | 20.89 | −1.24 | −1.30 | −9.64 |
| D-1605 | 6.55 | −53.67 | 3.48 | −9.38 |
| D-1606 | 2.69 | −23.77 | 2.27 | −1.67 |
| D-1607 | −17.91 | −51.36 | 6.31 | 10.90 |
| D-1608 | 27.20 | −32.06 | 18.56 | 3.72 |
| D-1609 | 18.06 | −19.53 | 7.54 | −5.72 |
| D-1610 | 0.29 | −5.19 | −1.21 | −14.22 |
| D-1611 | 7.55 | 36.89 | 5.34 | −0.83 |
| D-1612 | −12.84 | −19.84 | 24.77 | 13.24 |
| D-1613 | −12.97 | −75.43 | 19.45 | −2.76 |
| D-1614 | 41.14 | 37.89 | 14.31 | −4.57 |
| D-1615 | 27.30 | −41.74 | 23.10 | 14.97 |
| D-1616 | 12.94 | 3.94 | 24.94 | 30.37 |
| D-1617 | −12.74 | −28.74 | 11.92 | −7.36 |
| D-1618 | −21.59 | −33.88 | 21.75 | 9.98 |
| D-1620 | 12.43 | −59.95 | −6.31 | −6.82 |
| D-1621 | −26.08 | −48.87 | −11.78 | −11.89 |
| D-1622 | −11.28 | 6.47 | 13.22 | 4.49 |
| D-1624 | 11.89 | −55.62 | 15.64 | −2.82 |
| D-1625 | −23.14 | −30.97 | 13.42 | −0.85 |
| D-1626 | −48.99 | −63.51 | 17.15 | −3.64 |
| D-1628 | −1.56 | −38.82 | −1.09 | −13.60 |
| D-1629 | 22.68 | −43.27 | −2.76 | −9.65 |
| D-1630 | 42.94 | −59.46 | 13.31 | −0.07 |
| D-1631 | −7.87 | −61.54 | −5.43 | −11.47 |
| D-1632 | 31.45 | 40.65 | 3.40 | 1.39 |
| D-1633 | −1.02 | −42.12 | 2.32 | −10.80 |
| D-1634 | 9.14 | −31.08 | 16.35 | −8.94 |
| D-1635 | −21.74 | −62.17 | 3.57 | −6.98 |
| D-1636 | 19.09 | −24.92 | 8.88 | −24.34 |
| D-1637 | 24.00 | −50.62 | −9.16 | −13.04 |
| D-1638 | −26.95 | −66.99 | 10.06 | −9.12 |
| D-1639 | 1.01 | −36.90 | 8.95 | −4.91 |
| D-1640 | −11.91 | −64.78 | −0.16 | −9.43 |
| D-1641 | 4.60 | −48.90 | 5.64 | −16.05 |
| D-1642 | 0.58 | −41.02 | 18.35 | 1.62 |
| D-1643 | −8.85 | −76.54 | 9.54 | −15.54 |
| D-1644 | 10.51 | −52.89 | 20.58 | 14.19 |
| D-1645 | 12.87 | −71.23 | 12.16 | −0.54 |
| D-1646 | −5.78 | −74.08 | −4.69 | −27.01 |
| D-1647 | −4.45 | −5.92 | 6.63 | −8.13 |
| D-1648 | 13.46 | 34.26 | 22.88 | 4.87 |
| D-1649 | −47.63 | −56.76 | 4.12 | 8.02 |
| D-1650 | 32.58 | −59.12 | 4.05 | −9.81 |
| D-1651 | 1.84 | −64.00 | −3.73 | −17.15 |
| D-1652 | 15.30 | −41.66 | 4.28 | −10.21 |
| D-1654 | −5.23 | −33.75 | 3.00 | 3.66 |
| D-1655 | 6.87 | −42.73 | 14.47 | 8.55 |
| D-1657 | −2.37 | −52.43 | 4.98 | −15.30 |
| D-1658 | 2.03 | −18.81 | 19.00 | 8.79 |
| D-1659 | −9.57 | −59.55 | 23.74 | −15.69 |
| D-1660 | −26.48 | −74.55 | 19.78 | −2.82 |
| D-1661 | 17.81 | −38.33 | 41.55 | 0.20 |
| D-1662 | 14.45 | −52.42 | −0.59 | −27.08 |
| D-1663 | 4.07 | −58.51 | 2.59 | −16.05 |
| D-1664 | 15.20 | −53.44 | 6.39 | −8.56 |
| D-1665 | −23.06 | −68.84 | 21.96 | 14.62 |
| D-1666 | 13.84 | −40.77 | 3.64 | 2.18 |
| D-1667 | −24.50 | −45.47 | −9.04 | 6.51 |
| D-1668 | 6.61 | −78.38 | 9.62 | −24.13 |
| D-1669 | 25.32 | −65.31 | 27.36 | −27.95 |
| D-1670 | 9.53 | 20.77 | −11.62 | −24.98 |
| D-1671 | 14.18 | −38.83 | −1.66 | −12.03 |
| D-1672 | 10.69 | −42.66 | −1.83 | −19.00 |
| D-1673 | −6.87 | −12.52 | 12.45 | −2.14 |
| D-1674 | −3.44 | −30.88 | 17.10 | 12.97 |
| D-1675 | −41.19 | −75.58 | 12.13 | −15.82 |
| D-1676 | −12.87 | −60.60 | 15.24 | −7.71 |
| D-1677 | −13.84 | −38.01 | 2.26 | −9.77 |
| D-1679 | 6.72 | −42.72 | 10.87 | 1.76 |
| D-1680 | −0.82 | −58.97 | 2.49 | −4.77 |
| D-1681 | 2.40 | −70.08 | 3.89 | −16.35 |
| D-1682 | −22.79 | −48.92 | 10.87 | −4.47 |
| D-1684 | 16.50 | −50.83 | −2.16 | −13.61 |
| D-1685 | −16.42 | −79.02 | 7.62 | −61.49 |
| D-1686 | 4.79 | −74.35 | 6.72 | −13.30 |
| D-1688 | −16.27 | −49.27 | −6.81 | −19.80 |
| D-1689 | 3.43 | −73.67 | 0.91 | −18.82 |
| D-1690 | −22.68 | −21.68 | −5.75 | −7.62 |
| D-1691 | 15.82 | −72.63 | 0.75 | −33.93 |
| D-1692 | −8.53 | −65.87 | 23.18 | −2.19 |
| D-1693 | −6.53 | −52.63 | 2.49 | −13.30 |
| D-1695 | 18.62 | −73.01 | 0.73 | −16.64 |
| D-1696 | −27.53 | −41.20 | 12.86 | 11.56 |
| D-1697 | −0.63 | −76.21 | 33.11 | −5.40 |
| D-1698 | 10.73 | 5.15 | 24.35 | 24.10 |
| D-1699 | 7.59 | −49.15 | −2.19 | −15.43 |
| D-1700 | −5.47 | −42.44 | 24.90 | 13.63 |
| D-1701 | 7.02 | −9.16 | 9.08 | 5.69 |
| D-1702 | −47.80 | −24.11 | 13.81 | −4.71 |
| D-1703 | −2.85 | −61.94 | 9.13 | −4.88 |
| D-1704 | −27.90 | −8.32 | 9.89 | −13.37 |
| D-1705 | −37.01 | −46.48 | 3.32 | −9.17 |
| D-1706 | −19.28 | −32.88 | 1.70 | −8.36 |
| D-1707 | 7.69 | −21.74 | 9.05 | −6.05 |
| D-1708 | −16.50 | −57.74 | 6.64 | −3.44 |
| D-1710 | −16.79 | −65.45 | 6.80 | −10.38 |
| D-1711 | −28.36 | −56.25 | 7.76 | −4.87 |
| D-1712 | 17.37 | −18.44 | 3.32 | −13.05 |
| D-1714 | 26.79 | −33.16 | 7.78 | −4.00 |
| D-1715 | 4.22 | −53.78 | 11.83 | −10.35 |
| D-1717 | 0.87 | −57.74 | 7.92 | −3.01 |
| D-1718 | 35.62 | −38.40 | −0.40 | −11.07 |
| D-1720 | −5.71 | −66.00 | 5.50 | −9.46 |
| D-1721 | 29.47 | 45.96 | 20.42 | 15.01 |
| D-1723 | 9.72 | −28.91 | 0.00 | −30.34 |
| D-1724 | −9.58 | −71.18 | 3.80 | −9.56 |
| D-1725 | −12.29 | −58.30 | 5.17 | −5.90 |
| D-1726 | 18.53 | 8.84 | 8.13 | −5.66 |
| D-1727 | −8.35 | −79.86 | 14.31 | −27.31 |
| D-1728 | −14.50 | −78.33 | 6.36 | −27.01 |
| D-1729 | 17.39 | −6.03 | 29.92 | 11.54 |
| D-1730 | −45.31 | −77.60 | 20.83 | 1.51 |
| D-1731 | 15.79 | −18.18 | 1.78 | −9.77 |
| D-1732 | −16.21 | −4.72 | 17.10 | 4.67 |
| D-1733 | −0.64 | −75.43 | 17.74 | −13.23 |
| D-1735 | 16.55 | −62.74 | 7.52 | −11.28 |
| D-1736 | −19.47 | −52.32 | −3.00 | −9.23 |
| D-1737 | 5.41 | −9.57 | 25.94 | 15.76 |
| D-1738 | 5.35 | −35.18 | 15.13 | −10.09 |
| D-1739 | −10.18 | −57.04 | 15.48 | −15.92 |
| D-1740 | 10.75 | −73.85 | 0.42 | −21.93 |
| D-1742 | 13.07 | −19.18 | −4.93 | −6.50 |
| D-1743 | −2.56 | −27.26 | −4.73 | −11.73 |
| D-1744 | −7.60 | −70.94 | 10.71 | −1.73 |
| D-1745 | −1.21 | −44.21 | 1.16 | −15.57 |
| D-1746 | −19.08 | −74.88 | 14.64 | −18.38 |
| D-1747 | 6.70 | 16.51 | 0.42 | −12.56 |
| D-1749 | 2.52 | −40.74 | 10.35 | 2.28 |
| D-1751 | 2.95 | −76.84 | 7.05 | −18.50 |
| D-1753 | 2.02 | 15.57 | 12.97 | 19.69 |
| D-1754 | 17.30 | −1.58 | −7.05 | −21.69 |
| D-1755 | −20.55 | −74.51 | 8.79 | −16.00 |
| D-1756 | −45.60 | −12.19 | 16.17 | −1.67 |

TABLE 4-continued

In vitro efficacy of Tier 2 ASGR1 siRNA molecules in immunoassay screen

| Duplex No. | Cell count 5 nM | Normalized Alexa 488 Mean Intensity 5 nM | Cell count 1.25 nM | Normalized Alexa 488 Mean Intensity 1.25 nM |
|---|---|---|---|---|
| D-1757 | −26.04 | −61.16 | 12.21 | −7.81 |
| D-1758 | −0.34 | −73.97 | 47.63 | −8.80 |
| D-1759 | −63.51 | −69.49 | −24.07 | −41.37 |
| D-1760 | 5.76 | −43.12 | −0.91 | −9.97 |
| D-1761 | 42.43 | −57.23 | 18.09 | 8.26 |
| D-1762 | 0.10 | −69.14 | 10.67 | −6.73 |
| D-1763 | −5.81 | −62.90 | 34.11 | 14.42 |
| D-1764 | 6.21 | −72.39 | 5.92 | −22.06 |
| D-1765 | −11.10 | −37.69 | −1.76 | −2.05 |
| D-1766 | 0.52 | 4.89 | 14.20 | −11.31 |
| D-1767 | 18.43 | −46.54 | 19.50 | 0.02 |
| D-1768 | 12.02 | −74.19 | 2.92 | −14.64 |
| D-1769 | −0.34 | −55.25 | −2.90 | −21.94 |
| D-1770 | 3.43 | −35.46 | 1.33 | −9.24 |
| D-1771 | −1.18 | −35.96 | 18.93 | −2.23 |
| D-1772 | −32.57 | −78.62 | 60.42 | 3.61 |
| D-1774 | 24.50 | −76.51 | 20.00 | −23.79 |
| D-1775 | 21.92 | −1.67 | 20.58 | 3.16 |
| D-1776 | −0.64 | −69.08 | 3.51 | −14.00 |
| D-1778 | 14.85 | −43.29 | 7.13 | 3.09 |
| D-1779 | 45.23 | 9.53 | 7.47 | −2.55 |
| D-1780 | 6.36 | −53.12 | 16.21 | 5.81 |
| D-1781 | −9.63 | −55.20 | 3.01 | −13.99 |
| D-1782 | −7.40 | −37.94 | −2.35 | −13.41 |
| D-1783 | −11.80 | −39.91 | 15.38 | −0.50 |
| D-1784 | −27.14 | −62.76 | 7.72 | −15.32 |
| D-1785 | −24.69 | −56.81 | 0.57 | −20.48 |
| D-1786 | −53.14 | −57.69 | 7.62 | −13.19 |
| D-1787 | −1.98 | −67.56 | 14.61 | −14.64 |
| D-1788 | 22.85 | −27.66 | 11.40 | −4.65 |
| D-1789 | −57.57 | −60.25 | 3.65 | −2.84 |
| D-1790 | 18.68 | −77.95 | 16.25 | −18.72 |
| D-1791 | −7.31 | −74.76 | 15.24 | −6.11 |
| D-1793 | 28.65 | 16.33 | 12.45 | 5.71 |
| D-1794 | −17.68 | −20.87 | 1.46 | −7.31 |
| D-1795 | 17.95 | −73.95 | −1.74 | −27.64 |
| D-1796 | 5.95 | −23.80 | 7.30 | −7.46 |
| D-1797 | −6.72 | −51.09 | 11.70 | −3.05 |
| D-1798 | 12.40 | −2.59 | −8.59 | −8.33 |
| D-1799 | 8.91 | −59.33 | −2.27 | −19.09 |
| D-1800 | 18.52 | 17.09 | 2.45 | −4.63 |
| D-1801 | −18.92 | −22.39 | 11.12 | −12.94 |
| D-1802 | −3.58 | −78.22 | 2.34 | −13.75 |
| D-1803 | 7.69 | −66.70 | −0.66 | −17.72 |
| D-1804 | −22.94 | −78.51 | 16.40 | −15.98 |
| D-1805 | 12.14 | −36.01 | 17.76 | 9.49 |
| D-1806 | −10.65 | −73.01 | −1.86 | −36.31 |
| D-1809 | −2.23 | −62.22 | −3.38 | −12.14 |
| D-1810 | −2.27 | −50.18 | −7.88 | −12.36 |
| D-1811 | 20.62 | −78.33 | 10.83 | −4.71 |
| D-1812 | 6.46 | −63.75 | 15.80 | 5.89 |
| D-1813 | 26.26 | −34.46 | 3.24 | −5.20 |
| D-1815 | 21.72 | 24.33 | −0.91 | −15.26 |
| D-1816 | −1.27 | −62.68 | 0.65 | −15.01 |
| D-1817 | −37.56 | −48.82 | −8.49 | −10.71 |
| D-1818 | −20.79 | −49.64 | 0.32 | −14.74 |
| D-1820 | 1.94 | −66.41 | −12.77 | −12.94 |
| D-1821 | −27.34 | −55.96 | −5.69 | −15.96 |
| D-1822 | 15.72 | −13.71 | 5.89 | −8.21 |
| D-1823 | 36.98 | −54.48 | 7.03 | −7.59 |
| D-1824 | 15.05 | −38.99 | 12.20 | −4.28 |
| D-1825 | −17.23 | −62.99 | 17.95 | −0.48 |
| D-1826 | −1.74 | −79.64 | 8.73 | −30.66 |
| D-1827 | −9.29 | −36.07 | 0.00 | −8.87 |
| D-1828 | 32.08 | −63.24 | −1.16 | −20.15 |
| D-1829 | −12.97 | −80.27 | 17.54 | −16.16 |
| D-1830 | −18.62 | −21.58 | 0.81 | −16.10 |
| D-1831 | −25.78 | −74.69 | 16.99 | −12.92 |
| D-1832 | 9.24 | 16.76 | −10.29 | −21.96 |
| D-1833 | 31.56 | −68.81 | 13.34 | −1.42 |
| D-1834 | −10.26 | −74.52 | −1.21 | −27.17 |
| D-1835 | −12.48 | −67.28 | 3.77 | 0.84 |
| D-1836 | −13.17 | −7.34 | 20.13 | 17.39 |
| D-1837 | −11.36 | −20.19 | 3.48 | 4.61 |
| D-1838 | −14.31 | −32.03 | 14.06 | 1.71 |
| D-1839 | 10.51 | −63.37 | 11.43 | −5.04 |
| D-1841 | −16.26 | −72.93 | −5.25 | −20.49 |
| D-1843 | −46.20 | −72.45 | 7.14 | −13.01 |
| D-1844 | −4.79 | −42.61 | 15.60 | 9.77 |
| D-1845 | 35.78 | −30.99 | 15.31 | −11.75 |
| D-1846 | 30.49 | −44.75 | 4.53 | −10.21 |
| D-1847 | 13.03 | −44.91 | 9.72 | −12.37 |
| D-1849 | 4.40 | −50.27 | 4.32 | −11.51 |
| D-1850 | 22.87 | −19.62 | 9.48 | 2.97 |
| D-1851 | 10.16 | −50.32 | 10.83 | −2.40 |
| D-1852 | −2.03 | 3.30 | 6.39 | −10.53 |
| D-1853 | 8.76 | −34.41 | 11.54 | −0.96 |
| D-1854 | −10.75 | −32.54 | 1.86 | −1.55 |
| D-1855 | 6.49 | −75.79 | 9.86 | −13.88 |
| D-1856 | −11.66 | −70.52 | −4.07 | −27.14 |
| D-1857 | −7.50 | −2.38 | 13.44 | −5.69 |
| D-1858 | 13.63 | −54.80 | 2.27 | −14.00 |
| D-1859 | −17.17 | −75.64 | 6.56 | −17.77 |
| D-1860 | 6.58 | −76.19 | −5.16 | −13.59 |
| D-1861 | 19.57 | −39.30 | 16.86 | 13.06 |
| D-1862 | −5.71 | −73.94 | 4.85 | −8.72 |
| D-1863 | −47.23 | −81.66 | 41.00 | −8.60 |
| D-1864 | 23.90 | −75.44 | −0.16 | −26.92 |
| D-1865 | −2.85 | −33.66 | 17.34 | −7.39 |
| D-1866 | −41.34 | −73.70 | 4.20 | −7.31 |
| D-1867 | 7.01 | −43.86 | 23.49 | −4.81 |
| D-1868 | 27.33 | −45.04 | −15.44 | −23.60 |
| D-1869 | −2.02 | −38.29 | 16.32 | 0.19 |
| D-1870 | −3.25 | −72.86 | −3.89 | −33.61 |
| D-1871 | −6.24 | −59.17 | 6.53 | −8.23 |
| D-1872 | 6.06 | 12.20 | 27.36 | 18.31 |
| D-1873 | −19.65 | −62.34 | 3.15 | −7.44 |
| D-1875 | 11.66 | −45.27 | 6.22 | −6.88 |
| D-1877 | 28.40 | −51.53 | 4.40 | −19.08 |
| D-1878 | −13.50 | −29.09 | 5.98 | −8.53 |
| D-1879 | 1.09 | −29.39 | 12.09 | −9.43 |
| D-1880 | −2.56 | −47.80 | −0.17 | −6.36 |
| D-1881 | 58.17 | −50.55 | −2.26 | −19.24 |
| D-1882 | −26.82 | −47.71 | 2.51 | 10.76 |
| D-1883 | −22.50 | −13.68 | −13.61 | −21.06 |
| D-1884 | −2.70 | −35.00 | 19.02 | −4.66 |
| D-1885 | −7.50 | −73.19 | −4.56 | −34.52 |
| D-1886 | −8.82 | −20.72 | 6.89 | 11.71 |
| D-1887 | 11.23 | −66.61 | 1.94 | −17.52 |
| D-1888 | −4.79 | −17.84 | 6.06 | −4.70 |
| D-1889 | 7.59 | −57.31 | 15.07 | −11.89 |
| D-1890 | −32.37 | −68.00 | −4.48 | −15.63 |
| D-1891 | 38.80 | −18.11 | 5.75 | −12.54 |
| D-1892 | 3.63 | −9.46 | 9.72 | 12.53 |
| D-1893 | 5.33 | −62.04 | 13.70 | 8.34 |
| D-1894 | −16.08 | −66.91 | −3.48 | −18.47 |
| D-1895 | −39.37 | −54.73 | 10.65 | −3.04 |
| D-1896 | −34.17 | −68.67 | 20.94 | 2.68 |
| D-1897 | −12.55 | −79.14 | −1.18 | −30.09 |
| D-1898 | −6.96 | −68.28 | −1.78 | −18.90 |
| D-1899 | 20.72 | 26.23 | −11.80 | −14.61 |
| D-1900 | −3.73 | −64.22 | −2.82 | −23.57 |
| D-1901 | 6.36 | −58.44 | 5.35 | −2.99 |
| D-1902 | 1.26 | 21.40 | 23.69 | 10.04 |
| D-1903 | 3.94 | −74.24 | −0.25 | −14.16 |
| D-1904 | 0.68 | 50.23 | 2.51 | −9.54 |
| D-1905 | −19.08 | −76.82 | 10.88 | −17.12 |
| D-1906 | 17.08 | −43.53 | 9.46 | −4.79 |
| D-1907 | −19.00 | −52.03 | 0.34 | −20.89 |
| D-1908 | −21.93 | −49.22 | 18.58 | 14.88 |
| D-1909 | 17.59 | 12.47 | 0.41 | −5.27 |
| D-1910 | 12.10 | −37.19 | 2.43 | −10.38 |
| D-1911 | 4.31 | −60.58 | 19.92 | 7.26 |
| D-1912 | −7.69 | −34.13 | 2.59 | −5.43 |

TABLE 4-continued

In vitro efficacy of Tier 2 ASGR1 siRNA molecules in immunoassay screen

| Duplex No. | Cell count 5 nM | Normalized Alexa 488 Mean Intensity 5 nM | Cell count 1.25 nM | Normalized Alexa 488 Mean Intensity 1.25 nM |
|---|---|---|---|---|
| D-1913 | 4.68 | −7.14 | 21.84 | 10.42 |
| D-1914 | −9.95 | −40.94 | 20.02 | 0.05 |
| D-1915 | −9.20 | −12.41 | 0.40 | −10.13 |
| D-1916 | −90.09 | −69.70 | −1.42 | 10.86 |
| D-1917 | 7.80 | −21.88 | 21.09 | 3.31 |
| D-1918 | −13.11 | −77.48 | 6.72 | −61.74 |
| D-1919 | 0.14 | −38.79 | −5.67 | −17.31 |
| D-1920 | −29.72 | −58.58 | 19.83 | 9.16 |
| D-1921 | −12.68 | −59.75 | 1.05 | −14.09 |
| D-1922 | −19.56 | −54.13 | 6.68 | −10.08 |
| D-1923 | −5.61 | −43.21 | 16.29 | 12.59 |
| D-1924 | 12.82 | −72.06 | 17.18 | −2.29 |
| D-1925 | 16.97 | −17.78 | 19.41 | −2.83 |
| D-1926 | −15.49 | −11.77 | 68.39 | −20.57 |
| D-1927 | 11.32 | 4.87 | −4.40 | −23.95 |
| D-1928 | −6.06 | −28.46 | 24.85 | 9.59 |
| D-1930 | −6.58 | −79.22 | 17.16 | −29.12 |
| D-1931 | −3.39 | −62.32 | 5.61 | −16.80 |
| D-1932 | 9.76 | −2.23 | 10.05 | 7.37 |
| D-1933 | 4.31 | −53.82 | 5.06 | −1.69 |
| D-1934 | −14.29 | −22.36 | 15.56 | 8.75 |
| D-1935 | −3.85 | −49.95 | 2.34 | −6.40 |
| D-1936 | −9.91 | 22.02 | 0.59 | −6.11 |
| D-1937 | −3.73 | −61.11 | 4.32 | −21.53 |
| D-1938 | −35.33 | −77.39 | −7.36 | −22.69 |
| D-1939 | 11.46 | 7.47 | 3.24 | −6.37 |
| D-1940 | −42.29 | −45.97 | 12.47 | −5.61 |
| D-1941 | −8.16 | −45.74 | −2.27 | −7.42 |
| D-1942 | −3.00 | −55.85 | 16.65 | −10.14 |
| D-1943 | 33.68 | −31.48 | 3.72 | −12.52 |
| D-1944 | 11.42 | −58.08 | 3.04 | −16.01 |
| D-1945 | −31.07 | −68.98 | 10.70 | −6.84 |
| D-1946 | −36.79 | −48.50 | 19.41 | 12.95 |
| D-1947 | 5.52 | −18.81 | −7.54 | −11.92 |
| D-1948 | 0.24 | −72.84 | 12.53 | −1.26 |
| D-1949 | 22.59 | 8.84 | 14.94 | −0.84 |
| D-1950 | 19.69 | 13.83 | 0.08 | −9.03 |
| D-1951 | −23.67 | −77.04 | 2.43 | −12.37 |
| D-1952 | −25.79 | −72.15 | 7.29 | 4.56 |
| D-1953 | −41.63 | −54.76 | −4.37 | −19.62 |
| D-1954 | −16.50 | −74.90 | 26.47 | −9.31 |
| D-1955 | −21.01 | −16.60 | 16.01 | 9.73 |
| D-1956 | −8.95 | −74.13 | 13.94 | −22.70 |
| D-1957 | −15.05 | −73.45 | 19.25 | −5.72 |
| D-1958 | −17.04 | −42.99 | −8.57 | −21.64 |
| D-1959 | −0.24 | −74.53 | 10.37 | −52.59 |
| D-1960 | 5.66 | −39.86 | 0.50 | −6.53 |
| D-1961 | −15.14 | −39.35 | 4.27 | 3.43 |
| D-1962 | 15.69 | −64.81 | 3.10 | −12.12 |
| D-1963 | 0.62 | −55.52 | −5.16 | −14.03 |
| D-1964 | −16.11 | −8.15 | 4.15 | 0.01 |
| D-1965 | 18.91 | −68.13 | 16.29 | 5.58 |
| D-1966 | 7.31 | −66.61 | 18.67 | 2.02 |
| D-1967 | −31.59 | −27.69 | −1.33 | −18.19 |
| D-1968 | 14.95 | −50.53 | 10.04 | 2.00 |
| D-1969 | −39.37 | −49.73 | 11.83 | 3.08 |
| D-1970 | −30.04 | −71.01 | 10.46 | −3.76 |
| D-1971 | −1.36 | −0.35 | 7.76 | −3.39 |
| D-1972 | −10.99 | 92.17 | 5.92 | 8.11 |
| D-1973 | −26.54 | −38.10 | 1.22 | −7.75 |
| D-1974 | 14.04 | −47.50 | 8.73 | −4.02 |
| D-1976 | −14.47 | −28.64 | 10.05 | 2.14 |
| D-1977 | 13.03 | −14.91 | 6.78 | 8.02 |
| D-1978 | −17.61 | −72.14 | −0.25 | −34.74 |
| D-1979 | 12.20 | −66.67 | 0.40 | −20.96 |
| D-1980 | 4.78 | −7.88 | 8.03 | −4.08 |
| D-1981 | 22.46 | −78.74 | 11.96 | −23.68 |
| D-1982 | 7.06 | −42.71 | 13.64 | −14.16 |
| D-1983 | 147.43 | −45.73 | 7.46 | −4.83 |
| D-1984 | −9.43 | −56.18 | 18.85 | 8.40 |
| D-1985 | −7.26 | −78.52 | −2.18 | −23.49 |
| D-1986 | 11.55 | −54.27 | 10.78 | −0.74 |
| D-1988 | 18.49 | −80.12 | −1.70 | −32.09 |
| D-1989 | 32.04 | −77.89 | 18.27 | 2.40 |
| D-1990 | 17.46 | −18.79 | 3.90 | −13.24 |
| D-1991 | −7.01 | −59.92 | 1.99 | −11.66 |
| D-1992 | −82.84 | −61.20 | −12.64 | 2.49 |
| D-1993 | −9.27 | −46.43 | −3.01 | −10.66 |
| D-1995 | −0.19 | −75.26 | −6.87 | −30.20 |
| D-1996 | −11.66 | −50.74 | −13.03 | −29.47 |
| D-1997 | −25.96 | −44.39 | −5.94 | −21.93 |
| D-1998 | 19.63 | −42.79 | 14.23 | −2.70 |
| D-1999 | 3.87 | −79.84 | 21.26 | −32.79 |
| D-2000 | 5.27 | −19.03 | 1.00 | −3.02 |
| D-2001 | −15.70 | −39.55 | −3.40 | −20.23 |
| D-2002 | −0.19 | −12.14 | 1.13 | −15.73 |
| D-2003 | −9.36 | −42.27 | 3.51 | −10.63 |
| D-2004 | 19.17 | −13.09 | −0.59 | −8.71 |
| D-2005 | 27.82 | −62.21 | 4.40 | −23.84 |
| D-2006 | 7.31 | −26.36 | 9.24 | 3.49 |
| D-2007 | −52.29 | −25.86 | −13.89 | 0.39 |
| D-2009 | 15.41 | −56.60 | 30.54 | 4.40 |
| D-2011 | 5.07 | −7.16 | 0.42 | −6.12 |
| D-2012 | 3.49 | 14.31 | 9.62 | 5.80 |
| D-2013 | 29.17 | −28.96 | 10.62 | −13.66 |
| D-2014 | −9.43 | −56.66 | 23.92 | 3.59 |
| D-2015 | −5.66 | −13.26 | −4.48 | −19.19 |
| D-2016 | −7.79 | −48.27 | 6.22 | −11.50 |
| D-2017 | −29.08 | −10.09 | 8.46 | 6.59 |
| D-2018 | −12.29 | −42.04 | 5.01 | −18.67 |
| D-2019 | −9.38 | −27.60 | 2.27 | 3.19 |
| D-2020 | 5.41 | −67.72 | 14.31 | −3.73 |
| D-2022 | 6.39 | −35.46 | 6.31 | −0.92 |
| D-2023 | 19.27 | −72.15 | 26.28 | −23.46 |
| D-2024 | 4.76 | −55.12 | 10.21 | 8.48 |
| D-2025 | 24.01 | 0.84 | 5.82 | −4.60 |
| D-2026 | −9.82 | −31.92 | 13.44 | 2.43 |
| D-2027 | −10.47 | −39.71 | −13.78 | −16.75 |
| D-2028 | 25.85 | −25.14 | 7.11 | −6.77 |
| D-2029 | 9.58 | −27.90 | 18.84 | −6.92 |
| D-2030 | 25.17 | −4.33 | −1.05 | −8.23 |
| D-2031 | −46.06 | −61.25 | 15.98 | −1.88 |
| D-2032 | −1.28 | −54.49 | −8.62 | −19.41 |
| D-2033 | 37.48 | −27.95 | −7.46 | −21.48 |
| D-2034 | 20.28 | 33.72 | 6.95 | 3.41 |
| D-2035 | −27.81 | −53.97 | 19.10 | −7.38 |
| D-2036 | −9.78 | −59.60 | 8.25 | −7.34 |
| D-2037 | −16.17 | −59.12 | 14.10 | 4.42 |
| D-2038 | −2.48 | −78.15 | 26.11 | −3.69 |
| D-2039 | −17.52 | −77.24 | 4.94 | −0.89 |
| D-2040 | −7.25 | −54.11 | 11.63 | 0.72 |
| D-2041 | 9.57 | −11.47 | −7.05 | −6.10 |
| D-2042 | −18.34 | −29.19 | −1.05 | −8.78 |
| D-2043 | −3.12 | −66.07 | 11.63 | 1.50 |
| D-2044 | −37.56 | −32.28 | 21.91 | 8.04 |
| D-2045 | −22.65 | −75.89 | 2.02 | −21.05 |
| D-2046 | −13.91 | −74.75 | −1.46 | −20.68 |
| D-2047 | −16.88 | −53.39 | −9.96 | −30.30 |
| D-2048 | −13.58 | −76.86 | 16.90 | −27.20 |
| D-2049 | −36.21 | −9.07 | 7.60 | 5.07 |
| D-2051 | 2.56 | −51.79 | 3.24 | −1.81 |
| D-2052 | −18.34 | −46.56 | 12.48 | 15.60 |
| D-2053 | 20.23 | −39.84 | 3.72 | −13.74 |
| D-2055 | 7.15 | −78.38 | 7.69 | −15.41 |
| D-2056 | −2.39 | −26.69 | 17.99 | 7.25 |
| D-2057 | −3.21 | −61.15 | 1.76 | −13.42 |
| D-2058 | 15.87 | −21.62 | 3.63 | −12.54 |
| D-2060 | −48.44 | −77.63 | 6.86 | −42.35 |
| D-2061 | 14.50 | −79.48 | 19.67 | −3.72 |
| D-2062 | −16.59 | −70.67 | −3.65 | −21.31 |
| D-2063 | −7.01 | −76.15 | 9.71 | −28.36 |
| D-2065 | −4.40 | 14.16 | 14.19 | 0.97 |
| D-2067 | 21.53 | 3.99 | −8.46 | −21.68 |
| D-2068 | 23.43 | −75.39 | −3.40 | −26.63 |

TABLE 4-continued

In vitro efficacy of Tier 2 ASGR1 siRNA molecules in immunoassay screen

| Duplex No. | Cell count 5 nM | Normalized Alexa 488 Mean Intensity 5 nM | Cell count 1.25 nM | Normalized Alexa 488 Mean Intensity 1.25 nM |
|---|---|---|---|---|
| D-2069 | 2.42 | −79.04 | 22.39 | −11.16 |
| D-2070 | 9.38 | −61.91 | 19.53 | −0.10 |
| D-2071 | 0.52 | −65.61 | 9.08 | 7.54 |
| D-2072 | −5.23 | −78.42 | 7.28 | −24.05 |
| D-2073 | 22.59 | −3.89 | 21.08 | 10.82 |
| D-2074 | 21.01 | −72.33 | 3.07 | −21.93 |
| D-2075 | 30.14 | −58.62 | −3.65 | −14.55 |
| D-2076 | 5.13 | −54.39 | 17.95 | −0.94 |
| D-2077 | 5.76 | −53.36 | −6.31 | −22.62 |
| D-2078 | −2.95 | −27.45 | 5.31 | −6.53 |
| D-2079 | −9.00 | −76.93 | −1.94 | −18.14 |
| D-2080 | −20.91 | −41.76 | 18.51 | 2.13 |
| D-2082 | 1.38 | −3.34 | −1.76 | −12.55 |
| D-2083 | 13.85 | 12.36 | 23.10 | 10.70 |
| D-2084 | 4.26 | −45.51 | 3.64 | −5.08 |
| D-2085 | −21.45 | −69.45 | −1.70 | −12.65 |
| D-2086 | 14.31 | −25.67 | 5.19 | −9.77 |
| D-2087 | −10.64 | −72.79 | 11.30 | −7.89 |
| D-2088 | 33.03 | −49.42 | 11.55 | −4.08 |
| D-2089 | −12.31 | −71.20 | −0.16 | −12.87 |
| D-2090 | 2.23 | −13.02 | 4.53 | −8.06 |
| D-2091 | 5.50 | −30.25 | 3.26 | −8.25 |
| D-2092 | 25.21 | 9.46 | 26.06 | 9.99 |
| D-2093 | −30.01 | −56.61 | −2.51 | −10.01 |
| D-2094 | 3.24 | −50.65 | 12.20 | −1.38 |
| D-2096 | −7.87 | −47.43 | −6.81 | −18.01 |
| D-2097 | 3.08 | −48.50 | −3.72 | −12.37 |
| D-2098 | −5.85 | −44.10 | −15.52 | −16.11 |
| D-2099 | 1.74 | −30.12 | 27.36 | 8.16 |
| D-2100 | −1.85 | −27.99 | −0.85 | −15.43 |
| D-2101 | 9.57 | −15.62 | −13.37 | −32.49 |
| D-2102 | 17.20 | −17.54 | 8.11 | −13.47 |
| D-2103 | 18.26 | −14.51 | 19.92 | −2.74 |
| D-2104 | −20.60 | −52.42 | 15.88 | 9.47 |
| D-2105 | −13.44 | −36.40 | 0.16 | −2.69 |
| D-2106 | 7.45 | −24.35 | −6.14 | −8.94 |
| D-2108 | −26.79 | −47.50 | 8.03 | −6.12 |
| D-2109 | 28.75 | −61.84 | 7.03 | −18.38 |
| D-2110 | −15.98 | −64.33 | 11.83 | −4.94 |
| D-2111 | 3.58 | −25.27 | 11.63 | −0.29 |
| D-2112 | −30.49 | −70.57 | −7.11 | −23.03 |
| D-2113 | −21.34 | −45.95 | −7.97 | −11.53 |
| D-2114 | 2.37 | −38.94 | 15.52 | 4.19 |
| D-2116 | −0.77 | −16.52 | 7.68 | 0.82 |
| D-2117 | −34.56 | −77.15 | −0.97 | −27.34 |
| D-2118 | 39.37 | 1.68 | 17.34 | 4.87 |
| D-2119 | 35.75 | −62.09 | 19.42 | −3.86 |
| D-2120 | −15.98 | −37.99 | −3.57 | −10.72 |
| D-2121 | −20.70 | −45.64 | −0.65 | −0.80 |
| D-2122 | −28.27 | −75.45 | −8.49 | −10.90 |
| D-2123 | −3.00 | −30.45 | −12.77 | −21.76 |
| D-2125 | −20.37 | −46.48 | 12.20 | −8.72 |
| D-2126 | 15.87 | −14.95 | 15.23 | −8.82 |
| D-2127 | −14.04 | −41.88 | −0.89 | −20.13 |
| D-2128 | −0.37 | −32.88 | 9.54 | 6.92 |
| D-2129 | −5.66 | −42.51 | −2.74 | −16.04 |
| D-2131 | −5.23 | −60.82 | 17.74 | 0.02 |
| D-2132 | −7.91 | −58.89 | 14.37 | −3.66 |
| D-2135 | −9.68 | −76.64 | 10.59 | 1.08 |
| D-2138 | 32.66 | −43.04 | 15.77 | 3.66 |
| D-2139 | −6.65 | −37.39 | 10.37 | 0.22 |
| D-2140 | −12.02 | −44.16 | 2.93 | −13.13 |
| D-2141 | −25.79 | −65.81 | 0.00 | −3.03 |
| D-2142 | 18.26 | −9.97 | 11.72 | 12.29 |
| D-2143 | −40.37 | −41.64 | 10.54 | 6.24 |
| D-2144 | 17.30 | −77.66 | −0.73 | −30.74 |
| D-2145 | 15.14 | −73.75 | 7.55 | −20.41 |
| D-2146 | −12.43 | −66.84 | 9.71 | −17.02 |
| D-2147 | −2.79 | −80.26 | 8.20 | −11.80 |
| D-2148 | −13.12 | −50.55 | 6.17 | −16.80 |
| D-2149 | −14.10 | −73.21 | 1.05 | −16.43 |
| D-2150 | 8.57 | −11.20 | −2.20 | −15.48 |
| D-2151 | 3.25 | 16.20 | −11.67 | −16.45 |
| D-2152 | −27.82 | −27.09 | 3.07 | −9.90 |
| D-2153 | −8.20 | −28.11 | 14.71 | 2.34 |
| D-2154 | 8.26 | −57.95 | 5.69 | −6.42 |
| D-2155 | 29.28 | −26.90 | −0.16 | −8.87 |
| D-2156 | −8.63 | −39.94 | 4.29 | −1.85 |
| D-2157 | 40.98 | −49.72 | 15.81 | −7.89 |
| D-2158 | 1.27 | −64.90 | −20.18 | −19.77 |
| D-2159 | −11.46 | −62.75 | −5.51 | −19.74 |
| D-2160 | 4.74 | −52.84 | −2.34 | −16.92 |
| D-2161 | 51.01 | −43.91 | 6.03 | −11.46 |
| D-2162 | −10.09 | −45.16 | 5.61 | −2.10 |
| D-2163 | 3.12 | −48.22 | 51.05 | 6.96 |
| D-2164 | 39.79 | −69.13 | 8.00 | −19.97 |
| D-2165 | −0.53 | −74.56 | −4.32 | −27.16 |
| D-2166 | −2.18 | −65.81 | 11.45 | −16.77 |
| D-2167 | 24.40 | −53.07 | 27.98 | 16.39 |
| D-2168 | −25.14 | −30.88 | 7.53 | 5.06 |
| D-2169 | 7.45 | −56.17 | 16.17 | 2.89 |
| D-2170 | −37.06 | −62.46 | 6.69 | −14.30 |
| D-2171 | 0.90 | −53.35 | −5.11 | −15.32 |
| D-2173 | 39.14 | 5.84 | 12.37 | 8.02 |
| D-2175 | 1.55 | −63.15 | −1.46 | −11.53 |
| D-2176 | 8.07 | 48.04 | −6.19 | −6.21 |
| D-2177 | 18.72 | 22.15 | −4.54 | −9.19 |
| D-2178 | −10.11 | 0.12 | −0.66 | −4.23 |
| D-2179 | 0.00 | −27.63 | 1.62 | −13.12 |
| D-2180 | 11.04 | 13.22 | 0.17 | −3.68 |
| D-2181 | −28.17 | −16.03 | 2.76 | −10.31 |
| D-2182 | −25.91 | −41.36 | 0.08 | −11.30 |
| D-2183 | 24.88 | −43.72 | −2.67 | −10.89 |
| D-2184 | 18.20 | 18.68 | 11.96 | 11.68 |
| D-2185 | −20.32 | −41.43 | −7.54 | −26.81 |
| D-2186 | −10.37 | −73.28 | 11.38 | −12.70 |
| D-2187 | 19.46 | −20.05 | 10.59 | 10.67 |
| D-2188 | 1.02 | −70.09 | −1.74 | −15.96 |
| D-2189 | −14.50 | −38.26 | 1.42 | −14.19 |
| D-2190 | −18.24 | −61.71 | −9.79 | −17.99 |
| D-2191 | −15.04 | −62.87 | 15.80 | 4.20 |
| D-2193 | 9.58 | −59.04 | 7.44 | −1.72 |
| D-2194 | −11.18 | −44.01 | 14.69 | −2.00 |
| D-2195 | 19.07 | −44.55 | 15.76 | 5.22 |
| D-2197 | 13.12 | −25.85 | 6.61 | −12.79 |
| D-2198 | −4.68 | −35.17 | 4.02 | −10.32 |
| D-2199 | −8.27 | −48.07 | 14.61 | −3.49 |
| D-2201 | 12.39 | −68.13 | 13.26 | −8.12 |
| D-2203 | 5.96 | −47.61 | 22.26 | −0.47 |
| D-2204 | 17.20 | −2.70 | 14.12 | −7.52 |
| D-2205 | −0.37 | −2.53 | 3.93 | 0.78 |
| D-2206 | −1.94 | −36.37 | 16.57 | −4.49 |
| D-2207 | −34.95 | −53.37 | 19.41 | −3.59 |
| D-2208 | 15.05 | −61.50 | 8.37 | −14.17 |
| D-2209 | 21.64 | −73.66 | −10.21 | −41.26 |
| D-2211 | −30.08 | −42.14 | 9.89 | −7.13 |
| D-2212 | 29.46 | −73.39 | 7.72 | −15.28 |
| D-2213 | 2.69 | −46.37 | 1.86 | 8.25 |
| D-2214 | 38.33 | −53.84 | −5.92 | −11.50 |
| D-2215 | −23.67 | −54.98 | 17.74 | 2.12 |
| D-2216 | −55.59 | −72.78 | 1.86 | −11.28 |
| D-2217 | 29.27 | −69.54 | 14.23 | −22.52 |
| D-2218 | −26.43 | −76.79 | −6.39 | −27.46 |
| D-2219 | −10.55 | −50.41 | 7.52 | −16.12 |
| D-2220 | 5.52 | −13.82 | −3.40 | −2.47 |
| D-2221 | 30.40 | −61.88 | −2.59 | −19.75 |
| D-2222 | 43.30 | −48.47 | 4.32 | −3.69 |
| D-2223 | 24.63 | −62.30 | 3.32 | −5.52 |
| D-2225 | −6.63 | −42.35 | −9.38 | −21.15 |
| D-2226 | −38.62 | −62.87 | 10.46 | −8.69 |
| D-2227 | −23.94 | −50.40 | 9.29 | 10.89 |
| D-2228 | 20.09 | −29.75 | 14.14 | 0.05 |
| D-2229 | −18.06 | −31.06 | 11.10 | −14.24 |
| D-2231 | 9.00 | −61.35 | −13.34 | −22.09 |

TABLE 4-continued

In vitro efficacy of Tier 2 ASGR1 siRNA molecules in immunoassay screen

| Duplex No. | Cell count 5 nM | Normalized Alexa 488 Mean Intensity 5 nM | Cell count 1.25 nM | Normalized Alexa 488 Mean Intensity 1.25 nM |
|---|---|---|---|---|
| D-2232 | 14.77 | −76.09 | 17.15 | −3.37 |
| D-2233 | 7.21 | −8.78 | 0.17 | −10.36 |
| D-2234 | 1.28 | −72.80 | 15.23 | −43.35 |
| D-2235 | −37.16 | −74.11 | 20.67 | 2.73 |
| D-2237 | −8.85 | −51.03 | 0.25 | −19.94 |
| D-2239 | −27.30 | −73.35 | 0.97 | −14.70 |
| D-2240 | −27.96 | −75.24 | −4.46 | −17.10 |
| D-2241 | 11.91 | −72.70 | 20.45 | 3.61 |
| D-2242 | −0.33 | −35.08 | 14.34 | 7.58 |
| D-2243 | −36.81 | −74.89 | 4.31 | −11.89 |
| D-2244 | 30.62 | 38.57 | 13.86 | 4.28 |
| D-2245 | −18.07 | −41.66 | 7.87 | −9.64 |
| D-2246 | −6.14 | 56.28 | 29.46 | 28.50 |
| D-2247 | −25.60 | −73.58 | −4.44 | −16.28 |
| D-2248 | 11.51 | −20.86 | 2.87 | −9.83 |
| D-2249 | −16.91 | −39.16 | 0.34 | −14.24 |
| D-2250 | 15.77 | −73.36 | 10.48 | −8.70 |
| D-2251 | 0.43 | −79.99 | 10.74 | −17.83 |
| D-2252 | 6.05 | −65.41 | 5.15 | −14.74 |
| D-2253 | 11.10 | −54.80 | 38.74 | 15.88 |
| D-2254 | 22.21 | −14.24 | 10.79 | −10.26 |
| D-2255 | 41.07 | 18.44 | 6.97 | −2.34 |
| D-2256 | −8.23 | −46.19 | 2.59 | 3.33 |
| D-2257 | −6.65 | −9.03 | −2.27 | −7.54 |
| D-2258 | −7.71 | −76.29 | 5.44 | −7.30 |
| D-2259 | 14.95 | 68.74 | −17.68 | −12.68 |
| D-2260 | 9.67 | −20.49 | 0.97 | 4.43 |
| D-2261 | −24.00 | −45.64 | 13.13 | −0.23 |
| D-2262 | −10.92 | −17.68 | 17.57 | −0.15 |
| D-2263 | 3.34 | −74.25 | 4.98 | −19.68 |
| D-2264 | −8.47 | −74.97 | 8.13 | −7.51 |
| D-2265 | −11.80 | −58.43 | 28.74 | 27.99 |
| D-2268 | −4.67 | −42.18 | −9.56 | −9.46 |
| D-2269 | −8.42 | −50.28 | 5.98 | −6.48 |
| D-2270 | 8.82 | −56.73 | −3.81 | −31.28 |
| D-2271 | −15.05 | −41.32 | 12.61 | 5.63 |
| D-2272 | −2.18 | −51.38 | −13.44 | −20.07 |
| D-2273 | 0.87 | 7.40 | 2.43 | −10.08 |
| D-2274 | 6.84 | −68.97 | −7.29 | −31.31 |
| D-2275 | 17.04 | −20.30 | −4.20 | −17.23 |
| D-2276 | −19.08 | −59.63 | 8.45 | −16.02 |
| D-2277 | −5.23 | −9.32 | 10.54 | 8.24 |
| D-2278 | 16.94 | −47.09 | 5.58 | −2.28 |
| D-2279 | 10.98 | −57.75 | 3.98 | −13.27 |
| D-2280 | 10.99 | 0.50 | 17.83 | 8.21 |
| D-2281 | 3.78 | −7.60 | 7.76 | −7.03 |
| D-2282 | −37.16 | −66.11 | 12.47 | −6.97 |
| D-2283 | −8.81 | −13.66 | 17.66 | −1.44 |
| D-2284 | −6.53 | −56.80 | 18.51 | 1.11 |
| D-2285 | 9.68 | −18.56 | 3.96 | −9.57 |
| D-2286 | −16.88 | −62.09 | 15.77 | −11.21 |
| D-2287 | −7.59 | −35.92 | 9.08 | −6.25 |
| D-2288 | 4.20 | −68.32 | −11.91 | −18.58 |
| D-2289 | 5.56 | −52.09 | 17.51 | 4.86 |
| D-2290 | 47.89 | 3.79 | 15.98 | −2.50 |
| D-2291 | 4.59 | −58.65 | −8.12 | −6.02 |
| D-2292 | 5.27 | −66.33 | −4.90 | −20.75 |
| D-2293 | 16.75 | −52.01 | 21.10 | 6.47 |
| D-2295 | 38.62 | 12.59 | −12.72 | −10.00 |
| D-2297 | 10.83 | 15.03 | 2.26 | 6.34 |
| D-2298 | −4.69 | −2.09 | −2.32 | −13.00 |
| D-2299 | −32.86 | −69.77 | 4.05 | −13.11 |
| D-2302 | 26.26 | −51.02 | 7.13 | 4.49 |
| D-2303 | 11.28 | −45.64 | −3.77 | −19.21 |
| D-2305 | 17.40 | −23.21 | 0.41 | −10.26 |
| D-2306 | 22.94 | −53.98 | 10.63 | −13.70 |
| D-2307 | 19.46 | −39.96 | −1.46 | −13.70 |
| D-2308 | 9.36 | −64.54 | 7.53 | −13.04 |
| D-2309 | 14.37 | −72.06 | 6.47 | −19.58 |
| D-2310 | 24.72 | −29.06 | 8.38 | −9.31 |
| D-2311 | −11.17 | −39.70 | 8.91 | 9.42 |
| D-2312 | 19.21 | −71.67 | 12.28 | −11.47 |
| D-2313 | 19.65 | −21.49 | 3.15 | −11.19 |
| D-2314 | 26.15 | −33.61 | 14.56 | −7.81 |
| D-2315 | −13.03 | −53.10 | 10.65 | −9.69 |
| D-2316 | 2.42 | −29.40 | 10.91 | −11.39 |
| D-2317 | −24.49 | −67.65 | 8.33 | −5.38 |
| D-2318 | 9.72 | −40.13 | 8.70 | −3.99 |
| D-2319 | 23.72 | −77.03 | 5.51 | −63.69 |
| D-2320 | 25.70 | 8.69 | 8.27 | −0.77 |
| D-2321 | 8.13 | −69.42 | −17.95 | −37.39 |
| D-2323 | 28.07 | 2.72 | 20.42 | 3.41 |
| D-2324 | 2.89 | −56.23 | 12.76 | −8.95 |
| D-2325 | 13.50 | −77.16 | −4.23 | −14.43 |
| D-2326 | −3.05 | −59.64 | 21.16 | −9.55 |
| D-2327 | −12.00 | −46.84 | 6.14 | −3.12 |
| D-2328 | 6.84 | −40.50 | 10.62 | 8.44 |
| D-2329 | −1.31 | −9.41 | 7.72 | −7.80 |
| D-2330 | 4.59 | −69.60 | 10.79 | −8.67 |
| D-2331 | −9.54 | −73.22 | −9.79 | −29.41 |
| D-2332 | −6.55 | −72.41 | 8.51 | −6.94 |
| D-2333 | 11.17 | −2.82 | 15.48 | 11.15 |
| D-2334 | −2.66 | −75.33 | 12.72 | −9.84 |
| D-2335 | −23.27 | −67.78 | 10.62 | 2.39 |
| D-2336 | −11.80 | 40.65 | −1.01 | −6.78 |
| D-2337 | −15.32 | −76.42 | −2.59 | −32.42 |
| D-2338 | 15.49 | −74.04 | 21.13 | −1.29 |
| D-2339 | 20.66 | 15.26 | −14.02 | −26.53 |
| D-2340 | 26.04 | −1.14 | 7.03 | 4.64 |
| D-2341 | −7.40 | −74.83 | 20.50 | 3.23 |
| D-2342 | −15.34 | −55.08 | 4.90 | −10.82 |
| D-2343 | −12.29 | −46.10 | −10.21 | −20.14 |
| D-2344 | −23.43 | −48.16 | 4.54 | 5.25 |
| D-2345 | −33.71 | −27.73 | −9.81 | −24.68 |
| D-2346 | 6.88 | 13.79 | 2.68 | −10.88 |
| D-2347 | −18.07 | −43.48 | 20.00 | 28.83 |
| D-2348 | −47.43 | −50.28 | −6.14 | −19.13 |
| D-2349 | −5.71 | −72.76 | 0.40 | −30.56 |
| D-2350 | −2.48 | −3.02 | 11.13 | 12.54 |
| D-2351 | 20.23 | −0.55 | 14.59 | 16.95 |
| D-2352 | −26.04 | −79.85 | 2.83 | −41.79 |
| D-2353 | −26.97 | −3.97 | 11.30 | −9.21 |
| D-2355 | 13.01 | −62.85 | 7.05 | −10.93 |
| D-2356 | 22.02 | −42.24 | 4.27 | −3.90 |
| D-2357 | 24.78 | −73.44 | −0.32 | −16.90 |
| D-2358 | 28.79 | −18.62 | 1.16 | −9.13 |
| D-2359 | 16.26 | −75.14 | 0.89 | −50.36 |
| D-2361 | 42.98 | −75.85 | 2.67 | −15.94 |
| D-2363 | −8.25 | −40.20 | −1.94 | −1.25 |
| D-2364 | 11.83 | −29.04 | 14.99 | 7.35 |
| D-2365 | 39.82 | −71.52 | 27.63 | −14.32 |
| D-2366 | 15.79 | 17.44 | 3.57 | −1.02 |
| D-2367 | −34.63 | −60.76 | 6.17 | −13.96 |
| D-2368 | −10.37 | −68.39 | 18.24 | −21.70 |
| D-2369 | −12.78 | −49.28 | 5.09 | −0.64 |
| D-2370 | 0.19 | −52.13 | −14.96 | −30.52 |
| D-2371 | −21.17 | −76.37 | −5.27 | −26.92 |
| D-2372 | −22.46 | −77.36 | 12.13 | −17.20 |
| D-2373 | 25.98 | −27.45 | 11.37 | −10.77 |
| D-2375 | 6.51 | −70.26 | 9.54 | −30.77 |
| D-2376 | −18.34 | −34.30 | 7.94 | 2.16 |
| D-2377 | −0.05 | −19.93 | 11.29 | −7.45 |
| D-2378 | −8.76 | −55.07 | 0.08 | −17.21 |
| D-2379 | −42.39 | −67.16 | −1.86 | −19.30 |
| D-2380 | 9.85 | −50.55 | 6.24 | −15.88 |
| D-2381 | −18.14 | −72.98 | 28.13 | 10.21 |
| D-2382 | −7.36 | −26.01 | 13.66 | 10.26 |
| D-2383 | −39.36 | −62.24 | 18.58 | 13.73 |
| D-2384 | −12.59 | −56.52 | 14.75 | 9.42 |
| D-2385 | −10.79 | −48.93 | 1.58 | −5.69 |
| D-2386 | 46.35 | −44.45 | −5.59 | −14.76 |
| D-2387 | −15.88 | −46.20 | 2.10 | −19.49 |
| D-2389 | 13.76 | −78.69 | −3.01 | −28.91 |
| D-2390 | 9.10 | −30.45 | 17.67 | 2.11 |

TABLE 4-continued

In vitro efficacy of Tier 2 ASGR1 siRNA molecules in immunoassay screen

| Duplex No. | Cell count 5 nM | Normalized Alexa 488 Mean Intensity 5 nM | Cell count 1.25 nM | Normalized Alexa 488 Mean Intensity 1.25 nM |
|---|---|---|---|---|
| D-2391 | 12.29 | −56.75 | 4.93 | −21.32 |
| D-2392 | −23.49 | −74.83 | 5.02 | −33.62 |
| D-2393 | 16.84 | 3.98 | 14.39 | 1.42 |
| D-2394 | −2.71 | −70.98 | 13.26 | −11.62 |
| D-2395 | 7.89 | −27.03 | 4.65 | 2.79 |
| D-2396 | 16.82 | −16.14 | 16.91 | −3.49 |
| D-2397 | 2.12 | −35.82 | 3.89 | −3.96 |
| D-2398 | 9.57 | −41.40 | 18.96 | −0.05 |
| D-2399 | −47.71 | −61.72 | 28.20 | 0.37 |
| D-2400 | −8.35 | −72.99 | 17.07 | −18.54 |
| D-2401 | −28.01 | −75.77 | 1.16 | −14.75 |
| D-2402 | −33.04 | −76.71 | 18.09 | −77.25 |
| D-2404 | −7.61 | −67.29 | −1.09 | −41.79 |
| D-2405 | 0.05 | −17.64 | 3.00 | −0.09 |
| D-2406 | −9.58 | −33.64 | −10.59 | −25.33 |
| D-2407 | −9.63 | −62.24 | −0.08 | −13.96 |
| D-2408 | 14.42 | −3.00 | −6.79 | −16.32 |
| D-2409 | 27.04 | −34.28 | −4.73 | −20.25 |
| D-2410 | −18.30 | −67.46 | 16.81 | −7.29 |
| D-2411 | −21.28 | −57.25 | 12.72 | −8.07 |
| D-2413 | 4.95 | −60.16 | 10.46 | −0.22 |
| D-2414 | −17.33 | −64.07 | −14.55 | −6.78 |
| D-2415 | −15.05 | −65.69 | −9.46 | −17.88 |
| D-2416 | −0.99 | −75.16 | 11.26 | −3.94 |
| D-2417 | 3.05 | −76.41 | −0.91 | −33.96 |
| D-2418 | −1.93 | −24.85 | 29.04 | 17.48 |
| D-2419 | −24.40 | −47.12 | 4.18 | −3.30 |
| D-2420 | 16.06 | −58.83 | 4.35 | −25.40 |
| D-2421 | −1.37 | −74.32 | 9.56 | −21.07 |
| D-2422 | −38.14 | −48.49 | −11.91 | −24.13 |
| D-2423 | −20.41 | −60.80 | −0.41 | −9.66 |
| D-2424 | −48.40 | −65.04 | −2.10 | −8.61 |
| D-2425 | 28.94 | 15.14 | 14.20 | 6.12 |
| D-2426 | 7.89 | −47.66 | 16.10 | 2.93 |
| D-2427 | −19.09 | −23.01 | 1.62 | −3.94 |
| D-2428 | 5.56 | −11.55 | 11.62 | −5.34 |
| D-2429 | 0.52 | −33.21 | −11.43 | −24.16 |
| D-2430 | 4.41 | −37.30 | −3.55 | −16.45 |
| D-2431 | −37.67 | −67.95 | −1.54 | −9.79 |
| D-2432 | −25.32 | −68.85 | −4.13 | −20.36 |
| D-2433 | 0.52 | −71.18 | −7.86 | −31.49 |
| D-2434 | 10.40 | −37.19 | 10.54 | −13.54 |
| D-2435 | 4.86 | −57.38 | 17.34 | 20.49 |
| D-2436 | 18.88 | −35.44 | 23.12 | −12.39 |
| D-2437 | 25.79 | −40.05 | 15.35 | 1.03 |
| D-2438 | 15.05 | 9.99 | 6.80 | −9.53 |
| D-2439 | 21.63 | −41.11 | 18.17 | 2.50 |
| D-2440 | 37.57 | −0.17 | 2.20 | −12.17 |
| D-2441 | −8.06 | −54.57 | 13.61 | 7.61 |
| D-2442 | 36.79 | 57.61 | 5.61 | −6.44 |
| D-2443 | 11.36 | −66.78 | 2.92 | −13.62 |
| D-2444 | −38.81 | −72.85 | 8.54 | −3.71 |
| D-2445 | −11.04 | −64.66 | 8.08 | −2.29 |
| D-2446 | 3.82 | −42.52 | −10.45 | −14.16 |
| D-2447 | −7.91 | −58.98 | 13.44 | −4.86 |
| D-2448 | 7.34 | −12.66 | 4.65 | −11.66 |
| D-2449 | −31.64 | −2.57 | −7.05 | −21.21 |
| D-2450 | −18.81 | −37.87 | −0.24 | −4.80 |
| D-2451 | −9.05 | −65.54 | 8.96 | −5.60 |
| D-2452 | 7.97 | −72.48 | −5.11 | −13.04 |
| D-2453 | −4.77 | −45.85 | 12.38 | −13.76 |
| D-2454 | 21.10 | −54.04 | −4.37 | −13.62 |
| D-2455 | 8.18 | −71.54 | 5.31 | −22.07 |
| D-2456 | 11.23 | −30.35 | −2.67 | −15.16 |
| D-2457 | 5.60 | −60.92 | 1.84 | −1.91 |
| D-2458 | 21.64 | −76.04 | 4.05 | −4.69 |
| D-2459 | 32.73 | −39.55 | 12.68 | 2.47 |
| D-2460 | −13.78 | −51.39 | 10.57 | 11.22 |
| D-2461 | −18.30 | −80.09 | −13.02 | −48.39 |
| D-2463 | −24.85 | −9.05 | 6.56 | −10.92 |
| D-2464 | 8.42 | −30.80 | 13.50 | −8.82 |
| D-2467 | −8.91 | −35.24 | −1.05 | −16.07 |
| D-2469 | 9.90 | −74.91 | 12.09 | −2.50 |
| D-2470 | −16.83 | −18.78 | 9.64 | 4.78 |
| D-2471 | −13.11 | −39.34 | 17.59 | −0.33 |
| D-2472 | −51.91 | −74.29 | 0.08 | −22.90 |
| D-2473 | −23.85 | −64.30 | 4.48 | −3.65 |
| D-2474 | −18.97 | −73.74 | −9.30 | −20.23 |
| D-2476 | −12.39 | −39.15 | −5.50 | −14.58 |
| D-2477 | −36.35 | −71.63 | −9.00 | −8.89 |
| D-2478 | 5.73 | −71.48 | −7.35 | −21.50 |
| D-2479 | 29.53 | −66.03 | 6.47 | −17.15 |
| D-2480 | 13.11 | −73.36 | 1.49 | −45.78 |
| D-2482 | −1.37 | −14.22 | 26.88 | 7.58 |
| D-2483 | −26.46 | −76.11 | 9.13 | −15.10 |
| D-2484 | −7.16 | −76.11 | 14.31 | −8.27 |
| D-2485 | −6.97 | −64.92 | −0.65 | 2.47 |
| D-2486 | −38.05 | −65.90 | 10.21 | −3.14 |
| D-2488 | 4.40 | −65.48 | 23.24 | −1.45 |
| D-2489 | 10.61 | −50.59 | 2.76 | −16.97 |
| D-2490 | −6.92 | −56.48 | 13.36 | −5.04 |
| D-2491 | −28.11 | −69.71 | 10.95 | −11.63 |
| D-2492 | 4.59 | 34.94 | 21.34 | −5.76 |
| D-2493 | 9.43 | −74.40 | 19.78 | −3.04 |
| D-2494 | −8.07 | −59.67 | −2.85 | −15.61 |
| D-2495 | 0.92 | −8.01 | 22.82 | 8.68 |
| D-2496 | 23.04 | −8.86 | 14.79 | 2.59 |
| D-2497 | 6.97 | −9.05 | −5.74 | −17.82 |
| D-2498 | −0.92 | −30.75 | 5.10 | −9.22 |
| D-2499 | 3.63 | −39.99 | 12.48 | −5.26 |
| D-2500 | −0.48 | 13.29 | 22.96 | 11.73 |
| D-2501 | −7.36 | −19.71 | −3.48 | −6.31 |
| D-2502 | −17.21 | −41.54 | 16.86 | −1.63 |

The results from the screening assay of the Tier 2 molecules revealed an additional 663 potent siRNA molecules that reduced ASGR1 cell surface expression relative to control cells by at least 50% when tested at 5 nM. These siRNA molecules were not included in Tier 1 and were not identified from the bioinformatics analysis of the transcript sequences. At least 263 of these new siRNA molecules reduced ASGR1 cell surface expression relative to control cells by at least 70% and at least 14 siRNA molecules reduced ASGR1 cell surface expression relative to control cells by at least 80% when tested at 5 nM.

Example 3

Efficacy of Select ASGR1 siRNA Molecules in RNA FISH Assay

To assess the potency of a subgroup of ASGR1 siRNA molecules in reducing ASGR1 expression at the mRNA level, IC50 values were determined for each siRNA in an ASGR1 RNA Fluorescence In Situ Hybridization (FISH) assay. Hep3B cells (ATCC HB-8064) were transfected with siRNA using Lipofectamine RNAiMAX transfection reagent (ThermoFisher Scientific 13378-150), at 0.035 µL/reaction. Human ASGR1 siRNAs were tested in a 10 point dose response format, 3-fold dilutions, ranging from 0-83.3 nM, final concentration. Control siRNAs were tested at 5 nM, final concentration and included: a Neutral Control (used for normalization): Non-Targeting RcsC2 (UUA-CAUCGUUAAUGCGUUA (SEQ ID NO: 4316), an Inhibitor Positive Control: human ASGR1 (ACUU-CACAGCGAGCACGGA (SEQ ID NO: 4317), and a Transfection Control: human EIF4A3 (GCAUCUUG-GUGAAACGUGA (SEQ ID NO: 4318). Cells were seeded over the transfection complex at 2000 cells per reaction in Perkin Elmer Cell Carrier PDL-coated 384 well assay plates (Perkin Elmer #6007580). The transfection period was 96 hours, after which cells were fixed with 4% methanol free formaldehyde, final concentration. Directly post fixation, cells were dehydrated in ethanol following the Dehydrating Cells for Storage or Shipping protocol within the manufacturer's protocol for the Affymetrix QuantiGene View RNA HC Screening Assay. Plates were sealed and stored at −20° C.

According to the manufacturer's protocol, cells were rehydrated and processed in the Affymetrix QuantiGene View RNA HC Screening Assay, an in situ hybridization method to quantify messenger RNA levels. In this instance, the multiplex assay detected human ASGR1 (NM_001671.4; SEQ ID NO: 1), human ASGR2 (NM_0080912.3 or NM_001181.4), and human PPIB (NM_000942.4). The assay was carried out using the QG ViewRNA HC Screening Assay Kit and the QG ViewRNA HC Screening Signal Amp Kit, 3-plex (Affymetrix QVP0011 and QVP0213, respectively) and probe sets for the detection of human ASGR1, ASGR2 and PPIB (Affymetrix, VA6-19401-01, custom type 4 probe, VA1-10148-01 respectively). Each probe set is labeled with a different fluorophore. Protease for the digestion step was added at 1:8000, final concentration. Post assay, nuclei and cytoplasm were counterstained using Hoechst 33342 nuclear stain and Cell Mask Blue reagents (ThermoFisher Scientific H3570 and H32720 at final concentrations of 10 ng/µL and 4 ng/µL, respectively). Plate was imaged on the Perkin Elmer Phenix reading Hoechst and Cell Mask Blue in the UV channel, PPIB/Type1 in the 488 channel, ASGR2/Type4 in the 550 channel and ASGR1/Type6 in the 650 channel. Image acquisition and data analysis was completed in the Perkin Elmer Columbus software package and well normalization/IC50 value generation was completed in Genedata Screener.

The results of the assay are shown in Table 5. The IC50 values determined in the RNA FISH assay correlate with those determined in the immunoassay for ASGR1 protein levels described in Example 2. However, at the time points tested, the IC50 values determined in the RNA FISH assay are higher than those determined in the immunoassay.

TABLE 5

| IC50 values determined by RNA FISH assay for select ASGR1 siRNA molecules | |
|---|---|
| Duplex No. | IC50 (nM) |
| D-1168 | >83.33 |
| D-1170 | 0.62 |
| D-1171 | 1.74 |
| D-1173 | 1.65 |
| D-1176 | 5.12 |
| D-1206 | 4.70 |
| D-1235 | 1.57 |
| D-1389 | 0.68 |
| D-1397 | 1.06 |
| D-1408 | >83.33 |
| D-1443 | 0.58 |
| D-1497 | 3.65 |
| D-1708 | 0.05 |
| D-1815 | 1.18 |
| D-1826 | 3.47 |
| D-1981 | 1.81 |
| D-1989 | 2.07 |
| D-1999 | 0.27 |
| D-2000 | 7.04 |
| D-2142 | 9.26 |
| D-2143 | 4.42 |
| D-2357 | 0.40 |
| D-2361 | 1.42 |
| D-2401 | 1.73 |
| D-2461 | 4.03 |

Example 4

Design and Synthesis of Modified ASGR1 siRNA Molecules

To improve the potency and in vivo stability of the ASGR1 siRNA molecules, chemical modifications were incorporated into a subset of the most potent ASGR1 siRNA molecules from the Tier 1 and Tier 2 screens, including five of the most potent ASGR1 siRNA molecules from the Tier1 screen that also had sequence homology with mouse Asgr1 mRNA and cynomolgus monkey ASGR1 mRNA. Specifically, 2'-O-methyl and 2'-fluoro modifications of the ribose sugar were incorporated at specific positions within the ASGR1 siRNAs. Phosphorothioate internucleotide linkages were also incorporated at the terminal ends of the antisense and/or sense sequences. Table 6 below depicts the modifications in the sense and antisense sequences for each of the modified ASGR1 siRNAs. The nucleotide sequences in Table 6 are listed according to the following notations: A, U, G, and C=corresponding ribonucleotide; dT=deoxythymidine; a, u, g, and c=corresponding 2'-O-methyl ribonucleotide; Af, Uf, Gf, and Cf=corresponding 2'-deoxy-2'-fluoro ("2'-fluoro") ribonucleotide. Insertion of an "s" in the sequence indicates that the two adjacent nucleotides are connected by a phosphorothiodiester group (e.g. a phosphorothioate internucleotide linkage). Unless indicated otherwise, all other nucleotides are connected by 3'-5' phosphodiester groups. Each of the siRNA compounds in Table 6 comprises a 19 base pair duplex region with a 2 nucleotide overhang at the 3' end of both strands.

TABLE 6

| ASGR1 chemically modified siRNA Sequences | | | | |
|---|---|---|---|---|
| Duplex No. | Sense Sequence (5'-3') | SEQ ID NO: (sense) | Antisense Sequence (5'-3') | SEQ ID NO: (antisense) |
| D-3000 | AGGcccuAccGcuGGGucudTsdT | 3014 | AGACCcAGCGGuAGGGCCUdTsdT | 3665 |
| D-3001 | AfgGfcCfcUfAfCfCfGfcUfgGfgUfcUfuUf | 3015 | aGfaCfcCfaGfcgguaGfgGfcCfusUfsu | 3666 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3002 | AfgGfcCfcUfAfcCfGfcUfgGfgUfcUfuUf | 3016 | aGfaCfcCfaGfcgGfuaGfgGfcCfusUfsu | 3667 |
| D-3003 | AfgGfcCfcUfacCfGfcUfgGfgUfcUfuUf | 3017 | aGfaCfcCfaGfcgGfUfaGfgGfcCfusUfsu | 3668 |
| D-3004 | AfgGfcCfcUfaCfCfGfCfUfgGfgUfcUfuUf | 3018 | aGfaCfcCfagcggUfaGfgGfcCfusUfsu | 3669 |
| D-3005 | AfgGfcCfcUfaCfCfgCfUfgGfgUfcUfuUf | 3019 | aGfaCfcCfagCfggUfaGfgGfcCfusUfsu | 3670 |
| D-3006 | AfgGfcCfcUfaCfCfgcUfgGfgUfcUfuUf | 3020 | aGfaCfcCfaGfCfggUfaGfgGfcCfusUfsu | 3671 |
| D-3007 | AfgGfcCfcuAfCfcGfcUfgGfgUfcUfuUf | 3021 | aGfaCfcCfaGfcGfguAfGfgGfcCfusUfsu | 3672 |
| D-3008 | AfgGfcCfcUfaCfcGfCfuGfgGfcUfuUf | 3022 | aGfaCfcCfAfgcGfgUfaGfgGfcCfusUfsu | 3673 |
| D-3009 | AfsgsGfcCfcuAfCfcGfcUfgGfgUfcUfuUf | 3023 | asGfsaCfcCfaGfcGfguAfGfgGfcCfusUfsu | 3674 |
| D-3010 | AfgGfcCfcuAfCfcGfcUfgGfgUfcUfuUf | 3024 | aGfaCfcCfaGfcGfguAfGfgGfcCfuUfu | 3675 |
| D-3011 | AfsgsGfcCfcUfaCfcGfCfugGfgUfcUfuUf | 3025 | asGfsaCfcCfAfgcGfgUfaGfgGfcCfusUfsu | 3676 |
| D-3012 | AfgGfcCfcUfaCfcGfCfugGfgUfcUfuUf | 3026 | aGfaCfcCfAfgcGfgUfaGfgGfcCfuUfu | 3677 |
| D-3013 | AfgGfcCfcfuaCfcGfcUfgGfgUfcUfuUf | 3027 | aGfaCfcCfaGfcGfgUfAfggGfcCfusUfsu | 3678 |
| D-3014 | AfgGfccCfUfaCfcGfcUfgGfgUfcUfuUf | 3028 | aGfaCfcCfaGfcGfgUfagGfcCfusUfsu | 3679 |
| D-3015 | AfgGfCfccUfaCfcGfcUfgGfgUfcUfuUf | 3029 | aGfaCfcCfaGfcGfgUfaGfGfgcCfusUfsu | 3680 |
| D-3016 | AfggCfCfcUfaCfcGfcUfgGfgUfcUfuUf | 3030 | aGfaCfcCfaGfcGfgUfaGfggCfCfusUfsu | 3681 |
| D-3017 | AfGfgcCfcUfaCfcGfcUfgGfgUfcUfuUf | 3031 | aGfaCfcCfaGfcGfgUfaGfgGfCfcusUfsu | 3682 |
| D-3018 | aGfGfcCfcUfaCfcGfcUfgGfgUfcUfuUf | 3032 | aGfaCfcCfaGfcGfgUfaGfgGfccUfsUfsu | 3683 |
| D-3019 | agGfcCfcUfaCfcGfcUfgGfgUfcUfuUf | 3033 | aGfaCfcCfaGfcGfgUfaGfgGfcCfUfsusu | 3684 |
| D-3020 | AfgGfcCfcUfaCfcGfcuGfGfgUfcUfuUf | 3034 | aGfaCfccAfGfcGfgUfaGfgGfcCfusUfsu | 3685 |
| D-3021 | AfgGfcCfcUfaCfcGfcUfGfggGfcUfuUf | 3035 | aGfaCfCfcaGfcGfgUfaGfgGfcCfusUfsu | 3686 |
| D-3022 | AfgGfcCfcUfaCfcGfcUfggGfUfcUfuUf | 3036 | aGfacCfCfaGfcGfgUfaGfgGfcCfusUfsu | 3687 |
| D-3023 | AfgGfcCfcUfaCfcGfcUfgGfGfucUfuUf | 3037 | aGfAfccCfaGfcGfgUfaGfgGfcCfusUfsu | 3688 |
| D-3024 | AfgGfcCfcUfaCfcGfcUfgGfguCfUfuUf | 3038 | agAfCfcCfaGfcGfgUfaGfgGfcCfusUfsu | 3689 |
| D-3025 | AfgGfcCfcUfaCfcGfcUfgGfgUfCfuuUf | 3039 | AfgaCfcCfaGfcGfgUfaGfgGfcCfusUfsu | 3690 |
| D-3026 | AfgGfcCfcUfaCfcGfcUfgGfgUfcuUfUf | 3040 | AfGfaCfcCfaGfcGfgUfaGfgGfcCfusUfsu | 3691 |
| D-3027 | AfGfgcCfCfuaCfCfgcUfGfggUfCfuuUf | 3041 | AfgaCfCfcaGfCfggUfAfggGfCfcusUfsUf | 3692 |
| D-3028 | agGfCfccUfAfccGfCfugGfGfucUfUfu | 3042 | aGfAfccCfAfgcGfGfuaGfGfgcCfUfsusu | 3693 |
| D-3029 | AfggCfCfcuAfCfcgCfUfggGfUfcuUfUf | 3043 | AfGfacCfCfagCfGfguAfGfggCfCfsususUf | 3694 |
| D-3030 | aGfGfccCfUfacCfGfcuGfGfguCfUfuu | 3044 | agAfCfccAfGfcgGfUfagGfGfccUfsUfsu | 3695 |
| D-3031 | GuGGGAAGAAAGAuGAAGudTsdT | 3045 | ACUUcAUCUUUCUUCCcACdTsdT | 3696 |
| D-3032 | GfuGfgGfaAfGfAfAfAfgAfuGfaAfgUfuUf | 3046 | aCfuUfcAfuCfuuucuUfcCfcAfcsUfsu | 3697 |
| D-3033 | GfuGfgGfaAfGfaAfAfgAfuGfaAfgUfuUf | 3047 | aCfuUfcAfuCfuuUfcuUfcCfcAfcsUfsu | 3698 |
| D-3034 | GfuGfgGfaAfgaAfAfgAfuGfaAfgUfuUf | 3048 | aCfuUfcAfuCfuuUfCfuUfcCfcAfcsUfsu | 3699 |
| D-3035 | GfuGfgGfaAfgAfAfAfGfAfuGfaAfgUfuUf | 3049 | aCfuUfcAfucuuuCfuUfcCfcAfcsUfsu | 3700 |
| D-3036 | GfuGfgGfaAfgAfAfaGfAfuGfaAfgUfuUf | 3050 | aCfuUfcAfucUfuuCfuUfcCfcAfcsUfsu | 3701 |
| D-3037 | GfuGfgGfaAfgAfAfagAfuGfaAfgUfuUf | 3051 | aCfuUfcAfuCfUfuuCfuUfcCfcAfcsUfsu | 3702 |
| D-3038 | GfuGfgGfaaGfAfaAfgAfuGfaAfgUfuUf | 3052 | aCfuUfcAfuCfuUfucCfUfUfcCfcAfcsUfsu | 3703 |
| D-3039 | GfuGfgGfaAfgAfaAfGfauGfaAfgUfuUf | 3053 | aCfuUfcAfUfcuUfucCfuUfcCfcAfcsUfsu | 3704 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3040 | GfsusGfgGfaaGfAfaAfgAfuGfaAfgUfuUf | 3054 | asCfsuUfcAfuCfuUfucUfUfcCfcAfcsUfsu | 3705 |
| D-3041 | GfuGfgGfaaGfAfaAfgAfuGfaAfgUfuUf | 3055 | aCfuUfcAfuCfuUfucUfUfcCfcAfcUfu | 3706 |
| D-3042 | GfsusGfgGfaAfgAfaAfGfauGfaAfgUfuUf | 3056 | asCfsuUfcAfUfcuUfuCfuUfcCfcAfcsUfsu | 3707 |
| D-3043 | GfuGfgGfaAfgAfaAfGfauGfaAfgUfuUf | 3057 | aCfuUfcAfUfcuUfuCfuUfcCfcAfcUfu | 3708 |
| D-3044 | GfuGfgGfAfagAfaAfgAfuGfaAfgUfuUf | 3058 | aCfuUfcAfuCfuUfuCfUfucCfcAfcsUfsu | 3709 |
| D-3045 | GfuGfggAfAfgAfaAfgAfuGfaAfgUfuUf | 3059 | aCfuUfcAfuCfuUfcAfuuCfCfcAfcsUfsu | 3710 |
| D-3046 | GfuGfGfgaAfgAfaAfgAfuGfaAfgUfuUf | 3060 | aCfuUfcAfuCfuUfuCfuUfCfccAfcsUfsu | 3711 |
| D-3047 | GfugGfGfaAfgAfaAfgAfuGfaAfgUfuUf | 3061 | aCfuUfcAfuCfuUfcAfuUfccCfAfcsUfsu | 3712 |
| D-3048 | GfUfggGfaAfgAfaAfgAfuGfaAfgUfuUf | 3062 | aCfuUfcAfuCfuUfcuCfuUfcCfCfacsUfsu | 3713 |
| D-3049 | gUfGfgGfaAfgAfaAfgAfuGfaAfgUfuUf | 3063 | aCfuUfcAfuCfuUfcUfuCfCfcaCfsUfsu | 3714 |
| D-3050 | guGfgGfaAfgAfaAfgAfuGfaAfgUfuUf | 3064 | aCfuUfcAfuCfuUfcUfuCfCfcAfCfsusu | 3715 |
| D-3051 | GfuGfgGfaAfgAfaAfgaUfGfaAfgUfuUf | 3065 | aCfuUfcaUfCfuUfcUfuCfCfcAfcsUfsu | 3716 |
| D-3052 | GfuGfgGfaAfgAfaAfgAfUfgaAfgUfuUf | 3066 | aCfuUfCfauCfuUfuCfuUfcCfcAfcsUfsu | 3717 |
| D-3053 | GfuGfgGfaAfgAfaAfgAfugAfAfgUfuUf | 3067 | aCfuuCfAfuCfuUfuCfuUfcCfcAfcsUfsu | 3718 |
| D-3054 | GfuGfgGfaAfgAfaAfgAfuGfAfagUfuUf | 3068 | aCfUfucAfuCfuUfuCfuUfcCfcAfcsUfsu | 3719 |
| D-3055 | GfuGfgGfaAfgAfaAfgAfuGfaaGfUfuUf | 3069 | acUfUfcAfuCfuUfcUfuCfCfcAfcsUfsu | 3720 |
| D-3056 | GfuGfgGfaAfgAfaAfgAfuGfaAfGfuuUf | 3070 | AfcuUfcAfuCfuUfcUfuCfCfcAfcsUfsu | 3721 |
| D-3057 | GfuGfgGfaAfgAfaAfgAfuGfaAfguUfUf | 3071 | AfCfuUfcAfuCfuUfcUfuCfcAfcsUfsu | 3722 |
| D-3058 | GfUfggGfAfagAfafagAfUfgaAfGfuuUf | 3072 | AfcuUfCfauCfUfuuCfUfucCfCfacsUfsSf | 3723 |
| D-3059 | guGfGfgaAfGfaaAfGfauGfAfagUfUfu | 3073 | aCfUfucAfUfcuUfUfcuUfcCfccAfCfsusu | 3724 |
| D-3060 | GfugGfGfaaGfAfaaGfAfugAfAfguUfUf | 3074 | AfCfuuCfAfucuUfUfucUfuccCfAfcsusUf | 3725 |
| D-3061 | gUfGfggAfAfgaAfAfgaUfGfaaGfUfuu | 3075 | acUfUfcaUfCfuuUfCfuuCfCfcaCfsUfsu | 3726 |
| D-3062 | GAGAcGGGcuucAAGAAcudTsdT | 3076 | AGUUCUUGAAGCCCGUCUCdTsdT | 3727 |
| D-3063 | GfaGfaCfgGfGfCfUfUfcAfaGfaAfcUfuUf | 3077 | aGfuUfcUfuGfaagccCfgUfcUfcsUfsu | 3728 |
| D-3064 | GfaGfaCfgGfGfcUfUfcAfaGfaAfcUfuUf | 3078 | aGfuUfcUfuGfaaGfccCfgUfcUfcsUfsu | 3729 |
| D-3065 | GfaGfaCfgGfGfcUfUfcAfaGfaAfcUfuUf | 3079 | aGfuUfcUfuGfaaGfCfcCfgUfcUfcsUfsu | 3730 |
| D-3066 | GfaGfaCfgGfGfgCfUfUfCfAfaGfaAfcUfuUf | 3080 | aGfuUfcUfugaaGfcCfgUfcUfcsUfsu | 3731 |
| D-3067 | GfaGfaCfgGfGfgCfUfuCfAfaGfaAfcUfuUf | 3081 | aGfuUfcUfugAfagCfcCfgUfcUfcsUfsu | 3732 |
| D-3068 | GfaGfaCfgGfGfgCfUfucAfaGfaAfcUfuUf | 3082 | aGfuUfcUfuGfAfagCfcCfgUfcUfcsUfsu | 3733 |
| D-3069 | GfaGfaCfggGfCfuUfcAfaGfaAfcUfuUf | 3083 | aGfuUfcUfuGfaAfgcCfgUfcUfcsUfsu | 3734 |
| D-3070 | GfaGfaCfgGfgCfuUfCfaaGfaAfcUfuUf | 3084 | aGfuUfcUfUfgaAfgCfcCfgUfcUfcsUfsu | 3735 |
| D-3071 | GfsasGfaCfggGfCfuUfcAfaGfaAfcUfuUf | 3085 | asGfsuUfcUfuGfaAfgcCfgUfcUfcsUfsu | 3736 |
| D-3072 | GfaGfaCfggGfCfuUfcAfaGfaAfcUfuUf | 3086 | aGfuUfcUfuGfaAfgcCfgUfcUfcUfu | 3737 |
| D-3073 | GfsasGfaCfgGfgCfuUfCfaaGfaAfcUfuUf | 3087 | asGfsuUfcUfUfgaAfgCfcCfgUfcUfcsUfsu | 3738 |
| D-3074 | GfaGfaCfgGfgCfuUfCfaaGfaAfcUfuUf | 3088 | aGfuUfcUfUfgaAfgCfcCfgUfcUfcUfu | 3739 |
| D-3075 | GfaGfaCfGfggCfuUfcAfaGfaAfcUfuUf | 3089 | aGfuUfcUfuGfaAfgCfCfcgUfcUfcsUfsu | 3740 |
| D-3076 | GfaGfacGfGfgCfuUfcAfaGfaAfcUfuUf | 3090 | aGfuUfcUfuGfaAfgCfccGfUfcUfcsUfsu | 3741 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
| --- | --- | --- | --- | --- |
| D-3077 | GfaGfAfcgGfgCfuUfcAfaGfaAfcUfuUf | 3091 | aGfuUfcUfuGfaAfgCfcCfGfucUfcsUfsu | 3742 |
| D-3078 | GfagAfCfgGfgCfuUfcAfaGfaAfcUfuUf | 3092 | aGfuUfcUfuGfaAfgCfcCfguCfUfcsUfsu | 3743 |
| D-3079 | GfAfgaCfgGfgCfuUfcAfaGfaAfcUfuUf | 3093 | aGfuUfcUfuGfaAfgCfcCfgUfCfucsUfsu | 3744 |
| D-3080 | gAfGfaCfgGfgCfuUfcAfaGfaAfcUfuUf | 3094 | aGfuUfcUfuGfaAfgCfcCfgUfcuCfsUfsu | 3745 |
| D-3081 | gaGfaCfgGfgCfuUfcAfaGfaAfcUfuUf | 3095 | aGfuUfcUfuGfaAfgCfcCfgUfcUfCfsusu | 3746 |
| D-3082 | GfaGfaCfgGfgCfuUfcaAfGfaAfcUfuUf | 3096 | aGfuUfcuUfGfaAfgCfcCfgUfcUfcsUfsu | 3747 |
| D-3083 | GfaGfaCfgGfgCfuUfcAfAfgaAfcUfuUf | 3097 | aGfuUfCfuuGfaAfgCfcCfgUfcUfcsUfsu | 3748 |
| D-3084 | GfaGfaCfgGfgCfuUfcAfagAfAfcUfuUf | 3098 | aGfuuCfUfuGfaAfgCfcCfgUfcUfcsUfsu | 3749 |
| D-3085 | GfaGfaCfgGfgCfuUfcAfaGfAfacUfuUf | 3099 | aGfUfucUfuGfaAfgCfcCfgUfcUfcsUfsu | 3750 |
| D-3086 | GfaGfaCfgGfgCfuUfcAfaGfaaCfUfuUf | 3100 | agUfUfcUfuGfaAfgCfcCfgUfcUfcsUfsu | 3751 |
| D-3087 | GfaGfaCfgGfgCfuUfcAfaGfaAfCfuuUf | 3101 | AfguUfcUfuGfaAfgCfcCfgUfcUfcsUfsu | 3752 |
| D-3088 | GfaGfaCfgGfgCfuUfcAfaGfaAfcuUfUf | 3102 | AfGfuUfcUfuGfaAfgCfcCfgUfcUfcsUfsUfsu | 3753 |
| D-3089 | GfAfgaCfGfggCfUfucAfAfgaAfCfuuUf | 3103 | AfguUfCfuuGfAfagCfCfcgUfCfucsUfsUf | 3754 |
| D-3090 | gaGfAfcgGfGfcuUfCfaaGfAfacUfUfu | 3104 | aGfUfucUfUfgaAfgCfccCfgGfucUfCfsusu | 3755 |
| D-3091 | GfagAfCfggGfCfuuCfAfagAfAfcuUfUf | 3105 | AfGfuuCfUfugAfAfgcCfCfguCfUfcsusUf | 3756 |
| D-3092 | gAfGfacGfGfgcUfFfcaAfGfaaCfUfuu | 3106 | agUfUfcuUfGfaaGfCfccGfUfcuCfsUfsu | 3757 |
| D-3093 | GAGcGcAGcuGcuAcuGGudTsdT | 3107 | ACcAGuAGcAGCUGCGCUCdTsdT | 3758 |
| D-3094 | GfaGfcGfcAfgGfCfUfGfcUfaCfuGfgUfuUf | 3108 | aCfcAfgUfaGfcagcuGfcGfcUfcsUfsu | 3759 |
| D-3095 | GfaGfcGfcAfGfcUfGfcUfaCfuGfgUfuUf | 3109 | aCfcAfgUfaGfcaGfcuGfcGfcUfcsUfsu | 3760 |
| D-3096 | GfaGfcGfcAfgcUfGfcUfaCfuGfgUfuUf | 3110 | aCfcAfgUfaGfcaGfCfuGfcGfcUfcsUfsu | 3761 |
| D-3097 | GfaGfcGfcAfgCfUfGfCfUfaCfuGfgUfuUf | 3111 | aCfcAfgUfagcagCfuGfcGfcUfcsUfsu | 3762 |
| D-3098 | GfaGfcGfcAfgCfUfgCfUfaCfuGfgUfuUf | 3112 | aCfcAfgUfagCfagCfuGfcGfcUfcsUfsu | 3763 |
| D-3099 | GfaGfcGfcAfgCfUfgcUfaCfuGfgUfuUf | 3113 | aCfcAfgUfaGfCfagCfuGfcGfcUfcsUfsu | 3764 |
| D-3100 | GfaGfcGfcaGfCfuGfcUfaCfuGfgUfuUf | 3114 | aCfcAfgUfaGfcAfgcUfGfcGfcUfcsUfsu | 3765 |
| D-3101 | GfaGfcGfcAfgCfuGfCfuaCfuGfgUfuUf | 3115 | aCfcAfgUfAfgcAfgCfuGfcGfcUfcsUfsu | 3766 |
| D-3102 | GfsasGfcGfcaGfCfuGfcUfaCfuGfgUfuUf | 3116 | asCfscAfgUfaGfcAfgcUfGfcGfcUfcsUfsu | 3767 |
| D-3103 | GfaGfcGfcaGfCfuGfcUfaCfuGfgUfuUf | 3117 | aCfcAfgUfaGfcAfgcUfGfcGfcUfcUfu | 3768 |
| D-3104 | GfsasGfcGfcAfgCfuGfCfuaCfuGfgUfuUf | 3118 | asCfscAfgUfAfgcAfgCfuGfcGfcUfcsUfsu | 3769 |
| D-3105 | GfaGfcGfcAfgCfuGfCfuaCfuGfgUfuUf | 3119 | aCfcAfgUfAfgcAfgCfuGfcGfcUfcUfu | 3770 |
| D-3106 | GfaGfcGfCfagCfuGfcUfaCfuGfgUfuUf | 3120 | aCfcAfgUfaGfcAfgCfUfgcGfcUfcsUfsu | 3771 |
| D-3107 | GfaGfcgCfAfgCfuGfcUfaCfuGfgUfuUf | 3121 | aCfcAfgUfaGfcAfgCfugCfGfcUfcsUfsu | 3772 |
| D-3108 | GfaGfCfgcAfgCfuGfcUfaCfuGfgUfuUf | 3122 | aCfcAfgUfaGfcAfgCfuGfCfgcUfcsUfsu | 3773 |
| D-3109 | GfagCfGfcAfgCfuGfcUfaCfuGfgUfuUf | 3123 | aCfcAfgUfaGfcAfgCfuGfcgCfUfcsUfsu | 3774 |
| D-3110 | GfAfgcGfcAfgCfuGfcUfaCfuGfgUfuUf | 3124 | aCfcAfgUfaGfcAfgCfuGfcGfCfucsUfsu | 3775 |
| D-3111 | gAfGfcGfcAfgCfuGfcUfaCfuGfgUfuUf | 3125 | aCfcAfgUfaGfcAfgCfuGfcGfcuCfsUfsu | 3776 |
| D-3112 | gaGfcGfcAfgCfuGfcUfaCfuGfgUfuUf | 3126 | aCfcAfgUfaGfcAfgCfuGfcGfcUfCfsusu | 3777 |
| D-3113 | GfaGfcGfcAfgCfuGfcuAfCfuGfgUfuUf | 3127 | aCfcAfguAfGfcAfgCfuGfcGfcUfcsUfsu | 3778 |
| D-3114 | GfaGfcGfcAfgCfuGfcUfAfcuGfgUfuUf | 3128 | aCfcAfGfuaGfcAfgCfuGfcGfcUfcsUfsu | 3779 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3115 | GfaGfcGfcAfgCfuGfcUfacUfGfgUfuUf | 3129 | aCfcaGfUfaGfcAfgCfuGfcGfcUfcsUfsu | 3780 |
| D-3116 | GfaGfcGfcAfgCfuGfcUfaCfUfggUfuUf | 3130 | aCfCfagUfaGfcAfgCfuGfcGfcUfcsUfsu | 3781 |
| D-3117 | GfaGfcGfcAfgCfuGfcUfaCfugGfUfuUf | 3131 | acCfAfgUfaGfcAfgCfuGfcGfcUfcsUfsu | 3782 |
| D-3118 | GfaGfcGfcAfgCfuGfcUfaCfuGfGfuuUf | 3132 | AfccAfgUfaGfcAfgCfuGfcGfcUfcsUfsu | 3783 |
| D-3119 | GfaGfcGfcAfgCfuGfcUfaCfuGfguUfUf | 3133 | AfCfcAfgUfaGfcAfgCfuGfcGfcUfcsUfsu | 3784 |
| D-3120 | GfAfgcGfCfagCfUfgcUfAfcuGfGfuuUf | 3134 | AfccAfGfuaGfCfagCfUfgcGfCfucsUfsUf | 3785 |
| D-3121 | gaGfCfgcAfGfcuGfCfuaCfUfggUfUfu | 3135 | aCfCfagUfAfgcAfGfcuGfCfgcUfCfsusu | 3786 |
| D-3122 | GfagCfGfcaGfCfugCfUfacUfGfguUfUf | 3136 | AfCfcaGfUfagCfAfgcUfGfcgCfUfcsusUf | 3787 |
| D-3123 | gAfGfcgCfAfgcUfGfcuAfCfugGfUfuu | 3137 | acCfAfguAfGfcaGfCfugCfGfcuCfsUfsu | 3788 |
| D-3124 | GuuGucuGuGuGAucGGAudTsdT | 3138 | AUCCGAUcAcAcAGAcAACdTsdT | 3789 |
| D-3125 | GfuUfgUfcUfgUfGfuUfGfgAfuCfgGfaUfuUf | 3139 | aUfcCfgAfuCfacacaGfaCfaAfcsUfsu | 3790 |
| D-3126 | GfuUfgUfcUfgUfGfuUfgAfuCfgGfaUfuUf | 3140 | aUfcCfgAfuCfacAfcaGfaCfaAfcsUfsu | 3791 |
| D-3127 | GfuUfgUfcUfguGfUfgAfuCfgGfaUfuUf | 3141 | aUfcCfgAfuCfacAfCfaGfaCfaAfcsUfsu | 3792 |
| D-3128 | GfuUfgUfcUfgUfGfUfGfAfuCfgGfaUfuUf | 3142 | aUfcCfgAfucacaCfaGfaCfaAfcsUfsu | 3793 |
| D-3129 | GfuUfgUfcUfgUfGfuGfAfuCfgGfaUfuUf | 3143 | aUfcCfgAfucAfcaCfaGfaCfaAfcsUfsu | 3794 |
| D-3130 | GfuUfgUfcUfgUfGfugAfuCfgGfaUfuUf | 3144 | aUfcCfgAfuCfAfcaCfaGfaCfaAfcsUfsu | 3795 |
| D-3131 | GfuUfgUfcuGfUfgUfgAfuCfgGfaUfuUf | 3145 | aUfcCfgAfuCfaCfacAfGfaCfaAfcsUfsu | 3796 |
| D-3132 | GfuUfgUfcUfgUfgUfGfauCfgGfaUfuUf | 3146 | aUfcCfgAfUfcaCfaCfaGfaCfaAfcsUfsu | 3797 |
| D-3133 | GfsusUfgUfcuGfUfgUfgAfuCfgGfaUfuUf | 3147 | asUfscCfgAfuCfaCfacAfGfaCfaAfcsUfsu | 3798 |
| D-3134 | GfuUfgUfcuGfUfgUfgAfuCfgGfaUfuUf | 3148 | aUfcCfgAfuCfaCfacAfGfaCfaAfcUfu | 3799 |
| D-3135 | GfsusUfgUfcUfgUfGfuGfauCfgGfaUfuUf | 3149 | asUfscCfgAfUfcaCfaGfaCfaAfcsUfsu | 3800 |
| D-3136 | GfuUfgUfcUfgUfGfuGfauCfgGfaUfuUf | 3150 | aUfcCfgAfUfcaCfaCfaGfaCfaAfcUfu | 3801 |
| D-3137 | GfuUfgUfCfugUfgUfgAfuCfgGfaUfuUf | 3151 | aUfcCfgAfuCfaCfaCfAfgaCfaAfcsUfsu | 3802 |
| D-3138 | GfuUfguCfUfgUfgUfgAfuCfgGfaUfuUf | 3152 | aUfcCfgAfuCfaCfaCfagAfCfaAfcsUfsu | 3803 |
| D-3139 | GfuUfGfucUfgUfgUfgAfuCfgGfaUfuUf | 3153 | aUfcCfgAfuCfaCfaCfaGfAfcaAfcsUfsu | 3804 |
| D-3140 | GfuuGfUfcUfgUfgUfgAfuCfgGfaUfuUf | 3154 | aUfcCfgAfuCfaCfaCfaGfacAfcsUfsu | 3805 |
| D-3141 | GfUfugUfcUfgUfgUfgAfuCfgGfaUfuUf | 3155 | aUfcCfgAfuCfaCfaCfaGfaCfAfacsUfsu | 3806 |
| D-3142 | gUfUfgUfcUfgUfgUfgAfuCfgGfaUfuUf | 3156 | aUfcCfgAfuCfaCfaCfaGfaCfaaCfsUfsu | 3807 |
| D-3143 | guUfgUfcUfgUfgUfgAfuCfgGfaUfuUf | 3157 | aUfcCfgAfuCfaCfaCfaGfaCfaAfCfsusu | 3808 |
| D-3144 | GfuUfgUfcUfgUfgUfgaUfCfgGfaUfuUf | 3158 | aUfcCfgaUfCfaCfaCfaGfaCfaAfcsUfsu | 3809 |
| D-3145 | GfuUfgUfcUfgUfgUfgAfUfcgGfaUfuUf | 3159 | aUfcCfGfauCfaCfaCfaGfaCfaAfcsUfsu | 3810 |
| D-3146 | GfuUfgUfcUfgUfgUfgAfucGffaUfuUf | 3160 | aUfccGfAfuCfaCfaCfaGfaCfaAfcsUfsu | 3811 |
| D-3147 | GfuUfgUfcUfgUfgUfgAfuCfGfgaUfuUf | 3161 | aUfCfcgAfuCfaCfaCfaGfaCfaAfcsUfsu | 3812 |
| D-3148 | GfuUfgUfcUfgUfgUfgAfuCfggAfUfuUf | 3162 | auCfCfgAfuCfaCfaCfaGfaCfaAfcsUfsu | 3813 |
| D-3149 | GfuUfgUfcUfgUfgUfgAfuCfgGfAfuuUf | 3163 | AfucCfgAfuCfaCfaCfaGfaCfaAfcsUfsu | 3814 |
| D-3150 | GfuUfgUfcUfgUfgUfgAfuCfgGfauUfUf | 3164 | AfUfcCfgAfuCfaCfaCfaGfaCfaAfcsUfsu | 3815 |
| D-3151 | GfUfugUfCfugUfGfugAfUfcgGfAfuuUf | 3165 | AfucCfGfauCfAfcaCfAfgaCfAfacsUfsUf | 3816 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3152 | guUfGfucUfGfugUfGfauCfGfgaUfUfu | 3166 | aUfCfcgAfUfcaCfAfcaGfAfcaAfCfsusu | 3817 |
| D-3153 | GfuuGfUfcuGfUfguGfAfucGfGfauUfUf | 3167 | AfUfccGfAfucAfCfacAfGfacAfAfcsusUf | 3818 |
| D-3154 | gUfUfguCfUfguGfUfgaUfCfggAfUfuu | 3168 | auCfCfgaUfCfacAfCfagAfCfaaCfsUfsu | 3819 |
| D-3155 | GGAGcuGcGGGGccuGAGAdTsdT | 3169 | UCUcAGGCCCCGcAGCUCCdTsdT | 3820 |
| D-3156 | GfgAfgCfuGfCfGfGfgCfcUfgAfgAfuUf | 3170 | uCfuCfaGfgCfcccgcAfgCfuCfcsUfsu | 3821 |
| D-3157 | GfgAfgCfuGfCfgGfGfgCfcUfgAfgAfuUf | 3171 | uCfuCfaGfgCfccCfgcAfgCfuCfcsUfsu | 3822 |
| D-3158 | GfgAfgCfuGfcgGfGfgCfcUfgAfgAfuUf | 3172 | uCfuCfaGfgCfccCfGfcAfgCfuCfcsUfsu | 3823 |
| D-3159 | GfgAfgCfuGfcGfGfGfGfcUfgAfgAfuUf | 3173 | uCfuCfaGfgCfcccGfcAfgCfuCfcsUfsu | 3824 |
| D-3160 | GfgAfgCfuGfcGfGfgGfcUfgAfgAfuUf | 3174 | uCfuCfaGfgCfcCfccGfcAfgCfuCfcsUfsu | 3825 |
| D-3161 | GfgAfgCfuGfcGfGfggCfcUfgAfgAfuUf | 3175 | uCfuCfaGfgCfCfccGfcAfgCfuCfcsUfsu | 3826 |
| D-3162 | GfgAfgCfugCfGfgGfgGfcUfgAfgAfuUf | 3176 | uCfuCfaGfgCfcCfcgCfAfgCfuCfcsUfsu | 3827 |
| D-3163 | GfgAfgCfuGfcGfgGfGfccUfgAfgAfuUf | 3177 | uCfuCfaGfgCfccCfgCfgCfAfgCfuCfcsUfsu | 3828 |
| D-3164 | GfsgsAfgCfugCfgGfGfgCfcUfgAfgAfuUf | 3178 | usCfsuCfaGfgCfcCfcgCfAfgCfuCfcsUfsu | 3829 |
| D-3165 | GfgAfgCfugCfGfgGfgGfcUfgAfgAfuUf | 3179 | uCfuCfaGfgCfcCfcgCfAfgCfuCfcUfu | 3830 |
| D-3166 | GfsgsAfgCfuGfcGfgGfccUfgAfgAfuUf | 3180 | usCfsuCfaGfgCfccCfcGfcAfgCfuCfcsUfsu | 3831 |
| D-3167 | GfgAfgCfuGfcGfgGfccUfgAfgAfuUf | 3181 | uCfuCfaGfgCfccCfcGfcAfgCfuCfcUfu | 3832 |
| D-3168 | GfgAfgCfUfgcGfgGfgGfcUfgAfgAfuUf | 3182 | uCfuCfaGfgCfcCfcGfcCfagCfuCfcsUfsu | 3833 |
| D-3169 | GfgAfgcUfgCfcGfgGfgGfcUfgAfgAfuUf | 3183 | uCfuCfaGfgCfcCfcGfcaGfCfuCfcsUfsu | 3834 |
| D-3170 | GfgAfGfcuGfcGfgGfgGfcUfgAfgAfuUf | 3184 | uCfuCfaGfgCfcCfcGfcAfGfcuCfcsUfsu | 3835 |
| D-3171 | GfgaGfCfuGfcGfgGfgGfcUfgAfgAfuUf | 3185 | uCfuCfaGfgCfcCfcGfcAfgcUfCfcsUfsu | 3836 |
| D-3172 | GfGfagCfuGfcGfgGfgGfcUfgAfgAfuUf | 3186 | uCfuCfaGfgCfcCfcGfcAfgCfUfccsUfsu | 3837 |
| D-3173 | gGfAfgCfuGfcGfgGfgGfcUfgAfgAfuUf | 3187 | uCfuCfaGfgCfcCfcGfcAfgCfucCfsUfsu | 3838 |
| D-3174 | ggAfgCfuGfcGfgGfgCfcUfgAfgAfuUf | 3188 | uCfuCfaGfgCfcCfcGfcAfgCfuCfCfsusu | 3839 |
| D-3175 | GfgAfgCfuGfcGfgGfgcCfUfgAfgAfuUf | 3189 | uCfuCfagGfCfcCfcGfcAfgCfuCfcsUfsu | 3840 |
| D-3176 | GfgAfgCfuGfcGfgGfgCfCfugAfgAfuUf | 3190 | uCfuCfAfggCfcCfcGfcAfgCfuCfcsUfsu | 3841 |
| D-3177 | GfgAfgCfuGfcGfgGfgCfcuGfAfgAfuUf | 3191 | uCfucAfgGfcCfcCfcGfcAfgCfuCfcsUfsu | 3842 |
| D-3178 | GfgAfgCfuGfcGfgGfgCfcUfGfagAfuUf | 3192 | uCfUfcaGfgCfcCfcGfcAfgCfuCfcsUfsu | 3843 |
| D-3179 | GfgAfgCfuGfcGfgGfgCfcUfgaGfAfuUf | 3193 | ucUfCfaGfgCfcCfcGfcAfgCfuCfcsUfsu | 3844 |
| D-3180 | GfgAfgCfuGfcGfgGfgCfcUfgAfGfauUf | 3194 | UfcuCfaGfgCfcCfcGfcAfgCfuCfcsUfsu | 3845 |
| D-3181 | GfgAfgCfuGfcGfgGfgCfcUfgAfgaUfUf | 3195 | UfCfuCfaGfgCfcCfcGfcAfgCfuCfcsUfsu | 3846 |
| D-3182 | GfGfagCfUfgcGfgGfggCfCfugAfGfauUf | 3196 | UfcuCfAfggCfCfccGfCfagCfUfccsUfsUf | 3847 |
| D-3183 | ggAfGfcuGfCfggGfGfccUfGfagAfUfu | 3197 | uCfUfcaGfGfccCfCfgcAfGfcuCfCfsusu | 3848 |
| D-3184 | GfgaGfCfugCfGfggGfCfcuGfAfgaUfUf | 3198 | UfCfucAfGfgcCfCfcgCfAfgcUfCfcsusUf | 3849 |
| D-3185 | gGfAfgcUfCfcgGfGfgCfcUfUfgaGfAfuu | 3199 | ucUfCfagGfCfccCfGfcaGfCfucCfsUfsu | 3850 |
| D-3186 | GccGcuGGAAcGAcGAcGudTsdT | 3200 | ACGUCGUCGUUCcAGCGGCdTsdT | 3851 |
| D-3187 | GfcCfgCfuGfGfAfAfCfgAfcGfaCfgUfuUf | 3201 | aCfgUfcGfuCfguuccAfgCfgGfcsUfsu | 3852 |
| D-3188 | GfcCfgCfuGfGfaAfCfgAfcGfaCfgUfuUf | 3202 | aCfgUfcGfuCfguUfccAfgCfgGfcsUfsu | 3853 |
| D-3189 | GfcCfgCfuGfgaAfCfgAfcGfaCfgUfuUf | 3203 | aCfgUfcGfuCfguUfCfcAfgCfgGfcsUfsu | 3854 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3190 | GfcCfgCfuGfgAfAfCfGfAfcGfaCfgUfuUf | 3204 | aCfgUfcGfucguuCfcAfgCfgGfcsUfsu | 3855 |
| D-3191 | GfcCfgCfuGfgAfAfcGfAfcGfaCfgUfuUf | 3205 | aCfgUfcGfucGfuuCfcAfgCfgGfcsUfsu | 3856 |
| D-3192 | GfcCfgCfuGfgAfAfcgAfcGfaCfgUfuUf | 3206 | aCfgUfcGfuCfGfuuCfcAfgCfgGfcsUfsu | 3857 |
| D-3193 | GfcCfgCfugGfAfaCfgAfcGfaCfgUfuUf | 3207 | aCfgUfcGfuCfgUfucCfAfgCfgGfcsUfsu | 3858 |
| D-3194 | GfcCfgCfuGfgAfaCfGfacGfaCfgUfuUf | 3208 | aCfgUfcGfUfcgUfuCfcAfgCfgGfcsUfsu | 3859 |
| D-3195 | GfscsCfgCfugGfAfaCfgAfcGfaCfgUfuUf | 3209 | asCfsgUfcGfuCfgUfucCfAfgCfgGfcsUfsu | 3860 |
| D-3196 | GfcCfgCfugGfAfaCfgAfcGfaCfgUfuUf | 3210 | aCfgUfcGfuCfgUfucCfAfgCfgGfcUfu | 3861 |
| D-3197 | GfscsCfgCfuGfgAfaCfGfacGfaCfgUfuUf | 3211 | asCfsgUfcGfUfcgUfuCfcAfgCfgGfcsUfsu | 3862 |
| D-3198 | GfcCfgCfuGfgAfaCfGfacgfaCfgUfuUf | 3212 | aCfgUfcGfUfcgUfuCfcAfgCfgGfcUfu | 3863 |
| D-3199 | GfcCfgCfUfggAfaCfgAfcGfaCfgUfuUf | 3213 | aCfgUfcGfuCfgUfuCfCfagCfgGfcsUfsu | 3864 |
| D-3200 | GfcCfgcUfGfgAfaCfgAfcGfaCfgUfuUf | 3214 | aCfgUfcGfuCfgUfuCfcaGfCfgGfcsUfsu | 3865 |
| D-3201 | GfcCfGfcuGfgAfaCfgAfcGfaCfgUfuUf | 3215 | aCfgUfcGfuCfgUfuCfcAfGfcgGfcsUfsu | 3866 |
| D-3202 | GfccGfCfuGfgAfaCfgAfcGfaCfgUfuUf | 3216 | aCfgUfcGfuCfgUfuCfcAfgcGfGfcsUfsu | 3867 |
| D-3203 | GFcfcgCfuGfgAfaCfgAfcGfaCfgUfuUf | 3217 | aCfgUfcGfuCfgUfuCfcAfgCfGfgcsUfsu | 3868 |
| D-3204 | gCfCfgCfuGfgAfaCfgAfcGfaCfgUfuUf | 3218 | aCfgUfcGfuCfgUfuCfcAfgCfggCfsUfsu | 3869 |
| D-3205 | gcCfgCfuGfgAfaCfgAfcGfaCfgUfuUf | 3219 | aCfgUfcGfuCfgUfuCfcAfgCfgGfCfsusu | 3870 |
| D-3206 | GfcCfgCfuGfgAfaCfgaCfGfaCfgUfuUf | 3220 | aCfgUfcgUfCfgUfuCfcAfgCfgGfcsUfsu | 3871 |
| D-3207 | GfcCfgCfuGfgAfaCfgAfCfgaCfgUfuUf | 3221 | aCfgUfCfguCfgUfuCfcAfgCfgGfcsUfsu | 3872 |
| D-3208 | GfcCfgCfuGfgAfaCfgAfcgAfCfgUfuUf | 3222 | aCfguCfgUfcGfuCfcAfgCfgGfcsUfsu | 3873 |
| D-3209 | GfcCfgCfuGfgAfaCfgAfcGfAfcgUfuUf | 3223 | aCfGfucGfuCfgUfuCfcAfgCfgGfcsUfsu | 3874 |
| D-3210 | GfcCfgCfuGfgAfaCfgAfcGfacGfUfuUf | 3224 | acGfUfcGfuCfgUfuCfcAfgCfgGfcsUfsu | 3875 |
| D-3211 | GfcCfgCfuGfgAfaCfgAfcGfaCfGfuuUf | 3225 | AfcgUfcGfuCfgUfuCfcAfgCfgGfcsUfsu | 3876 |
| D-3212 | GfcCfgCfuGfgAfaCfgAfcGfaCfguUfUf | 3226 | AfCfgUfcGfuCfgUfuCfcAfgCfgGfcsUfsu | 3877 |
| D-3213 | GfCfcgCfUfggAfAfcgAfCfgaCfgCfGfuuUf | 3227 | AfcgUfCfguCfGfuuCfCfagCfGfgcsUfsUf | 3878 |
| D-3214 | gcCfGfcuGfGfaaCfGfacGfAfcgUfUfu | 3228 | aCfGfucGfUfcgUfUfccAfGfcgGfCfsusu | 3879 |
| D-3215 | GfccGfCfugGfafacGfAfcgAfCfguUfUf | 3229 | AfCfguCfGfucGfUfuccCfAfgcGfGfcsusUf | 3880 |
| D-3216 | gCfCfgcUfGfgaAfCfgaCfGfacGfUfuu | 3230 | acGfUfcgUfCfguUfCfcaGfCfggCfsUfsu | 3881 |
| D-3217 | GcAGcuGcuAcuGGuucucdTsdT | 3231 | GAGAACcAGuAGcAGCUGCdTsdT | 3882 |
| D-3218 | GfcAfgCfuGfCfUfAfCfuGfgUfuCfuCfuUf | 3232 | gAfgAfaCfcAfguagcAfgCfuGfcsUfsu | 3883 |
| D-3219 | GfcAfgCfuGfCfuAfCfuGfgUfuCfuCfuUf | 3233 | gAfgAfaCfcAfguAfgcAfgCfuGfcsUfsu | 3884 |
| D-3220 | GfcAfgCfuGfcuAfCfuGfgUfuCfuCfuUf | 3234 | gAfgAfaCfcAfguAfGfcAfgCfuGfcsUfsu | 3885 |
| D-3221 | GfcAfgCfuGfcUfAfCfUfgGfgUfuCfuCfuUf | 3235 | gAfgAfaCfcAfcaguaGfcAfgCfuGfcsUfsu | 3886 |
| D-3222 | GfcAfgCfuGfcUfAfcUfGfgUfuCfuCfuUf | 3236 | gAfgAfaCfcaGfuaGfcAfgCfuGfcsUfsu | 3887 |
| D-3223 | GfcAfgCfuGfcUfAfcuGfgUfuCfuCfuUf | 3237 | gAfgAfaCfcAfGfuaGfcAfgCfuGfcsUfsu | 3888 |
| D-3224 | GfcAfgCfugCfUfaCfuGfgUfuCfuCfuUf | 3238 | gAfgAfaCfcAfgUfagCfAfgCfuGfcsUfsu | 3889 |
| D-3225 | GfcAfgCfuGfcUfaCfUfggUfuCfuCfuUf | 3239 | gAfgAfaCfCfagUfaGfcAfgCfuGfcsUfsu | 3890 |
| D-3226 | GfscsAfgCfugCfUfaCfuGfgUfuCfuCfuUf | 3240 | gsAfsgAfaCfcAfgUfagCfAfgCfuGfcsUfsu | 3891 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3227 | GfcAfgCfugCfUfaCfuGfgUfuCfuCfuUf | 3241 | gAfgAfaCfcAfgUfagCfAfagCfuGfcUfu | 3892 |
| D-3228 | GfscsAfgCfuGfcUfaCfUfggUfuCfuCfuUf | 3242 | gsAfsgAfaCfCfagUfaGfcAfgCfuGfcsUfsu | 3893 |
| D-3229 | GfcAfgCfuGfcUfaCfUfggUfuCfuCfuUf | 3243 | gAfgAfaCfCfagUfaGfcAfgCfuGfcUfu | 3894 |
| D-3230 | GfcAfgCfUfgcUfaCfuGfgUfuCfuCfuUf | 3244 | gAfgAfaCfcAfgUfaGfCfagCfuGfcsUfsu | 3895 |
| D-3231 | GfcAfgcUfGfcUfaCfuGfgUfuCfuCfuUf | 3245 | gAfgAfaCfcAfgUfaGfcaGfCfuGfcsUfsu | 3896 |
| D-3232 | GfcAfGfcuGfcUfaCfuGfgUfuCfuCfuUf | 3246 | gAfgAfaCfcAfgUfaGfcAfGfcuGfcsUfsu | 3897 |
| D-3233 | GfcaGfCfuGfcUfaCfuGfgUfuCfuCfuUf | 3247 | gAfgAfaCfcAfgUfaGfcAfgcUfGfcsUfsu | 3898 |
| D-3234 | GfCfagCfuGfcUfaCfuGfgUfuCfuCfuUf | 3248 | gAfgAfaCfcAfgUfaGfcAfgCfUfgcsUfsu | 3899 |
| D-3235 | gCfAfgCfuGfcUfaCfuGfgUfuCfuCfuUf | 3249 | gAfgAfaCfcAfgUfaGfcAfgCfugCfsUfsu | 3900 |
| D-3236 | gcAfgCfuGfcUfaCfuGfgUfuCfuCfuUf | 3250 | gAfgAfaCfcAfgUfaGfcAfgCfuGfCfsusu | 3901 |
| D-3237 | GfcAfgCfuGfcUfaCfuGfgGfUfuCfuCfuUf | 3251 | gAfgAfaCfcAfgUfaGfcAfgCfuGfcsUfsu | 3902 |
| D-3238 | GfcAfgCfuGfcUfaCfuGfGfuuCfuCfuUf | 3252 | gAfgAfAfccAfgUfaGfcAfgCfuGfcsUfsu | 3903 |
| D-3239 | GfcAfgCfuGfcUfaCfuGfguUfCfuCfuUf | 3253 | gAfgaAfCfcAfgUfaGfcAfgCfuGfcsUfsu | 3904 |
| D-3240 | GfcAfgCfuGfcUfaCfuGfgUfUfcuCfuUf | 3254 | gAfGfaaCfcAfgUfaGfcAfgCfuGfcsUfsu | 3905 |
| D-3241 | GfcAfgCfuGfcUfaCfuGfgUfucUfCfuUf | 3255 | gaGfAfaCfcAfgUfaGfcAfgCfuGfcsUfsu | 3906 |
| D-3242 | GfcAfgCfuGfcUfaCfuGfgUfuCfUfcuUf | 3256 | GfagAfaCfcAfgUfaGfcAfgCfuGfcsUfsu | 3907 |
| D-3243 | GfcAfgCfuGfcUfaCfuGfgUfuCfucUfUf | 3257 | GfAfgAfaCfcAfgUfaGfcAfgCfuGfcsUfsu | 3908 |
| D-3244 | GfCfagCfUfgcUfAfcuGfGfuuCfUfcuUf | 3258 | GfagAfAfccAfGfuaGfcAfgCfUfgcsUfsSf | 3909 |
| D-3245 | gcAfGfcuGfCfuaCfUfggUfUfcuCfUfu | 3259 | gAfGfaaCfCfagUfAfgcAfGfcuGfCfsusu | 3910 |
| D-3246 | GfcaGfCfugCfUfacUfGfguUfCfucUfUf | 3260 | GfAfgaAfCfcaGfUfagCfAfgcUfGfcsusUf | 3911 |
| D-3247 | gCfAfgcUfGfcuAfCfugGfUfucUfCfuu | 3261 | gaGfAfacCfAfguAfGfcaGfCfugCfsUfsu | 3912 |
| D-3248 | GcuGGGucuGcGAGAcAGAdTsdT | 3262 | UCUGUCUCGcAGACCcAGCdTsdT | 3913 |
| D-3249 | GfcUfgGfgUfCfUfgGfCfgAfgAfcAfgAfuUf | 3263 | uCfuGfuCfuCfgcagaCfcCfaGfcsUfsu | 3914 |
| D-3250 | GfcUfgGfgUfCfuGfCfgAfgAfcAfgAfuUf | 3264 | uCfuGfuCfuCfgcAfgaCfcCfaGfcsUfsu | 3915 |
| D-3251 | GfcUfgGfgUfcuGfCfgAfgAfcAfgAfuUf | 3265 | uCfuGfuCfuCfgcAfGfaCfcCfaGfcsUfsu | 3916 |
| D-3252 | GfcUfgGfgUfcUfGfCfGfAfgAfcAfgAfuUf | 3266 | uCfuGfuCfuCfgcaGfaCfcCfaGfcsUfsu | 3917 |
| D-3253 | GfcUfgGfgUfcUfGfcGfAfgAfcAfgAfuUf | 3267 | uCfuGfuCfuCfgfcaGfaCfcCfaGfcsUfsu | 3918 |
| D-3254 | GfcUfgGfgUfcUfGfcgAfgAfcAfgAfuUf | 3268 | uCfuGfuCfuCfGfcaGfaCfcCfaGfcsUfsu | 3919 |
| D-3255 | GfcUfgGfguCfUfgCfgAfgAfcAfgAfuUf | 3269 | uCfuGfuCfuCfgCfagAfCfcCfaGfcsUfsu | 3920 |
| D-3256 | GfcUfgGfgUfcUfgCfGfagAfcAfgAfuUf | 3270 | uCfuGfuCfUfcgCfaGfaCfcCfaGfcsUfsu | 3921 |
| D-3257 | GfscsUfgGfguCfUfgCfgAfgAfcAfgAfuUf | 3271 | usCfsuGfuCfuCfgCfagAfCfcCfaGfcsUfsu | 3922 |
| D-3258 | GfcUfgGfguCfUfgCfgAfgAfcAfgAfuUf | 3272 | uCfuGfuCfuCfgCfagAfCfcCfaGfcUfu | 3923 |
| D-3259 | GfscsUfgGfgUfcUfgCfGfagAfcAfgAfuUf | 3273 | usCfsuGfuCfUfcgCfaGfaCfcCfaGfcsUfsu | 3924 |
| D-3260 | GfcUfgGfgUfcUfgCfGfagAfcAfgAfuUf | 3274 | uCfuGfuCfUfcgCfaGfaCfcCfaGfcUfu | 3925 |
| D-3261 | GfcUfgGfGfucUfgCfgAfgAfcAfgAfuUf | 3275 | uCfuGfuCfuCfgCfaGfAfccCfaGfcsUfsu | 3926 |
| D-3262 | GfcUfggGfUfcUfgCfgAfgAfcAfgAfuUf | 3276 | uCfuGfuCfuCfgCfaGfacCfCfaGfcsUfsu | 3927 |
| D-3263 | GfcUfgggUfcUfgCfgAfgAfcAfgAfuUf | 3277 | uCfuGfuCfuCfgCfaGfaCfcaGfcsUfsu | 3928 |
| D-3264 | GfcuGfGfgUfcUfgCfgAfgAfcAfgAfuUf | 3278 | uCfuGfuCfuCfgCfaGfaCfccAfGfcsUfsu | 3929 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
| --- | --- | --- | --- | --- |
| D-3265 | GfCfugGfgUfcUfgCfgAfgAfcAfgAfuUf | 3279 | uCfuGfuCfuCfgCfaGfaCfcCfAfgcsUfsu | 3930 |
| D-3266 | gCfUfgGfgUfcUfgCfgAfgAfcAfgAfuUf | 3280 | uCfuGfuCfuCfgCfaGfaCfcCfagCfsUfsu | 3931 |
| D-3267 | gcUfgGfgUfcUfgCfgAfgAfcAfgAfuUf | 3281 | uCfuGfuCfuCfgCfaGfaCfcCfaGfCfsusu | 3932 |
| D-3268 | GfcUfgGfgUfcUfgCfgaGfAfcAfgAfuUf | 3282 | uCfuGfucUfCfgCfaGfaCfcCfaGfcsUfsu | 3933 |
| D-3269 | GfcUfgGfgUfcUfgCfgAfGfacAfgAfuUf | 3283 | uCfuGfUfcuCfgCfaGfaCfcCfaGfcsUfsu | 3934 |
| D-3270 | GfcUfgGfgUfcUfgCfgAfgaCfAfgAfuUf | 3284 | uCfugUfCfuCfgCfaGfaCfcCfaGfcsUfsu | 3935 |
| D-3271 | GfcUfgGfgUfcUfgCfgAfgAfCfagAfuUf | 3285 | uCfUfguCfuCfgCfaGfaCfcCfaGfcsUfsu | 3936 |
| D-3272 | GfcUfgGfgUfcUfgCfgAfgAfcaGfAfuUf | 3286 | ucUfGfuCfuCfgCfaGfaCfcCfaGfcsUfsu | 3937 |
| D-3273 | GfcUfgGfgUfcUfgCfgAfgAfcAfGfauUf | 3287 | UfcuGfuCfuCfgCfaGfaCfcCfaGfcsUfsu | 3938 |
| D-3274 | GfcUfgGfgUfcUfgCfgAfgAfcAfgaUfUf | 3288 | UfCfuGfuCfuCfgCfaGfaCfcCfaGfcsUfsu | 3939 |
| D-3275 | GfCfugGfgUfucUfgCfcgAfGfacAfgAfauUf | 3289 | UfcuGfUfcuCfgCfcaGfAfccCfAfgcsUfsUf | 3940 |
| D-3276 | gcUfgGfggUfCfugCfgCfgagAfCfagAfUfu | 3290 | uCfUfguCfUfcgCfAfgaCfCfcaGfCfsusu | 3941 |
| D-3277 | GfcuGfgGfguCfUfgcGfAfgaCfAfgaUfUf | 3291 | UfCfugUfCfucGfCfagAfCfccAfGfcsusUf | 3942 |
| D-3278 | gCfUfggGfUfcuGfCfgaGfAfcaGfAfuu | 3292 | ucUfGfucUfCfgcAfGfacCfCfagCfsUfsu | 3943 |
| D-3279 | GcuuucucGGGAAuuuucAdTsdT | 3293 | UGAAAAUUCCCGAGAAAGCdTsdT | 3944 |
| D-3280 | GfcUfuUfcUfCfGfgGfgGfaAfuUfuUfcAfuUf | 3294 | uGfaAfaAfuUfcccgaGfaAfaGfcsUfsu | 3945 |
| D-3281 | GfcUfuUfcUfCfgGfgGfaAfuUfuUfcAfuUf | 3295 | uGfaAfaAfuUfccCfgaGfaAfaGfcsUfsu | 3946 |
| D-3282 | GfcUfuUfcUfcgGfGfaAfuUfuUfcAfuUf | 3296 | uGfaAfaAfuUfccCfgaGfaAfaGfcsUfsu | 3947 |
| D-3283 | GfcUfuUfcUfcGfGfgGfaAfAfuUfuUfcAfuUf | 3297 | uGfaAfaAfuuccCfgaGfaAfaGfcsUfsu | 3948 |
| D-3284 | GfcUfuUfcUfcGfGfgGfAfaAfuUfuUfcAfuUf | 3298 | uGfaAfaAfuuCfccGfaGfaAfaGfcsUfsu | 3949 |
| D-3285 | GfcUfuUfcUfcGfGfgGfgaAfuUfuUfcAfuUf | 3299 | uGfaAfaAfuUfCfccGfaGfaAfaGfcsUfsu | 3950 |
| D-3286 | GfcUfuUfcuCfGfgGfgGfaUfuUfuUfcAfuUf | 3300 | uGfaAfaAfuUfcCfCfcgAfGfaAfaGfcsUfsu | 3951 |
| D-3287 | GfcUfuUfcUfcGfgGfGfAfauUfuUfcAfuUf | 3301 | uGfaAfaAfAfUfucCfcCfgaGfaAfaGfcsUfsu | 3952 |
| D-3288 | GfscsUfuUfcuCfgGfgGfaAfuUfuUfcAfuf | 3302 | usGfsaAfaAfuUfcCfcgAfgGfaAfaGfcsUfsu | 3953 |
| D-3289 | GfcUfuUfcuCfgGfaAfuUfuUfcAfuUf | 3303 | uGfaAfaAfuUfcCfcgAfGfgAfaAfaGfcUfu | 3954 |
| D-3290 | GfscsUfuUfcUfcCfgGfgGfAfauUfuUfcAfuUf | 3304 | usGfsaAfaAfUfucCfcCfgfaGfaAfaGfcsUfsu | 3955 |
| D-3291 | GfcUfuUfcUfcGfgGfgGfAfauUfuUfcAfuUf | 3305 | uGfaAfaAfUfucCfcCfgfaGfaAfaGfcUfu | 3956 |
| D-3292 | GfcUfuUfCfucGfgGfaAfuUfuUfcAfuUf | 3306 | uGfaAfaAfuUfcCfCfGfgfaGfaAfaGfcsUfsu | 3957 |
| D-3293 | GfcUfuuCfUfcGfgGfaAfuUfuUfcAfuUf | 3307 | uGfaAfaAfuUfcCfCfcgGfagAfaAfaGfcsUfsu | 3958 |
| D-3294 | GfcUfUfucUfcGfgGfaAfuUfuUfcAfuUf | 3308 | uGfaAfaAfuUfcCfCfcgGfaGfAfaaGfcsUfsu | 3959 |
| D-3295 | GfcuUfUfcUfcGfgGfaAfuUfuUfcAfuUf | 3309 | uGfaAfaAfuUfcCfCfcgGfaaAfGfcsUfsu | 3960 |
| D-3296 | GfCfuuUfcUfcGfgGfaAfuUfuUfcAfuUf | 3310 | uGfaAfaAfuUfcCfCfcgGfaGfaAfAfgcsUfsu | 3961 |
| D-3297 | gCfUfuUfcUfcGfgGfaAfuUfuUfcAfuUf | 3311 | uGfaAfaAfuUfcCfCfcgGfaGfaAfagCfsUfsu | 3962 |
| D-3298 | gcUfuUfcUfcGfgGfaAfuUfuUfcAfuUf | 3312 | uGfaAfaAfuUfcCfCfcgGfaGfaAfaGfCfsusu | 3963 |
| D-3299 | GfcUfuUfcUfcGfgGfgaaUfuUfcAfuUf | 3313 | uGfaAfaaUfUfcCfCfcgGfaGfaAfaGfcsUfsu | 3964 |
| D-3300 | GfcUfuUfcUfcGfgGfgGfaAfUfuuUfcAfuUf | 3314 | uGfaAfAfauUfcCfCfcgGfaGfaAfaGfcsUfsu | 3965 |
| D-3301 | GfcUfuUfcUfcGfgGfgGfaAfuuUfUfcAfuUf | 3315 | uGfaaaAfAfuUfcCfCfcgGfaGfaAfaGfcsUfsu | 3966 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3302 | GfcUfuUfcUfcGfgGfaAfuUfUfucAfuUf | 3316 | uGfAfaaAfuUfcCfcGfaGfaAfaGfcsUfsu | 3967 |
| D-3303 | GfcUfuUfcUfcGfgGfaAfuUfuuCfAfuUf | 3317 | ugAfAfaAfuUfcCfcGfaGfaAfaGfcsUfsu | 3968 |
| D-3304 | GfcUfuUfcUfcGfgGfaAfuUfuUfCfauUf | 3318 | UfgaAfaAfuUfcCfcGfaGfaAfaGfcsUfsu | 3969 |
| D-3305 | GfcUfuUfcUfcGfgGfaAfuUfuUfcaUfUf | 3319 | UfGfaAfafuUfcCfcGfaGfaAfaGfcsUfsu | 3970 |
| D-3306 | GfCfuuUfCfucGfGfgaAfUfuuUfCfauUf | 3320 | UfgaAfAfauUfCfccGfAfgaAfAfgcsUfsUf | 3971 |
| D-3307 | gcUfUfucUfCfggGfAfauUfUfucAfUfu | 3321 | uGfAfaaAfUfucCfCfgaGfAfaaGfCfsusu | 3972 |
| D-3308 | GfcuUfUfcuCfGfggAfAfuuUfUfcaUfUf | 3322 | UfGfaaAfAfuuCfCfcgAfGfaaAfGfcsusUf | 3973 |
| D-3309 | gCfUfuuCfUfcgGfGfaaUfUfuuCfAfuu | 3323 | ugAfAfaaUfUfccCfGfagAfAfagCfsUfsu | 3974 |
| D-3310 | ccuccuGcuGcuuGuGGuudTsdT | 3324 | AACcAcAAGcAGcAGGAGGdTsdT | 3975 |
| D-3311 | CfcUfcCfuGfCfUfGfCfuUfgUfgGfuUfuUf | 3325 | aAfcCfaCfaAfgcagcAfgGfaGfgsUfsu | 3976 |
| D-3312 | CfcUfcCfuGfCfuGfCfuUfgUfgGfuUfuUf | 3326 | aAfcCfaCfaAfgcAfgcAfgGfaGfgsUfsu | 3977 |
| D-3313 | CfcUfcCfuGfcuGfCfuUfgUfgGfuUfuUf | 3327 | aAfcCfaCfaAfgcAfGfcAfgGfaGfgsUfsu | 3978 |
| D-3314 | CfcUfcCfuGfcUfGfCfUfUfgUfgGfuUfuUf | 3328 | aAfcCfaCfaagcaGfcAfgGfaGfgsUfsu | 3979 |
| D-3315 | CfcUfcCfuGfcUfGfcUfUfgUfgGfuUfuUf | 3329 | aAfcCfaCfaaGfcaGfcAfgGfaGfgsUfsu | 3980 |
| D-3316 | CfcUfcCfuGfcUfGfcuUfgUfgGfuUfuUf | 3330 | aAfcCfaCfaAfGfcaGfcAfgGfaGfgsUfsu | 3981 |
| D-3317 | CfcUfcCfuGfcUfugCfUfgCfuUfgUfgGfuUfuUf | 3331 | aAfcCfaCfaAfgCfagCfAfgGfaGfgsUfsu | 3982 |
| D-3318 | CfcUfcCfuGfcUfcGfUfugUfgGfuUfuUf | 3332 | aAfcCfaCfAfagCfaGfcAfgGfaGfgsUfsu | 3983 |
| D-3319 | CfscsUfcCfugCfUfgCfuUfgUfgGfuUfuUf | 3333 | asAfscCfaCfaAfgCfagCfAfgGfaGfgsUfsu | 3984 |
| D-3320 | CfcUfcCfugCfUfgCfuUfgUfgGfuUfuUf | 3334 | aAfcCfaCfaAfgCfagCfAfgGfaGfgUfu | 3985 |
| D-3321 | CfscsUfcCfuGfcUfgCfUfugUfgGfuUfuUf | 3335 | asAfscCfaCfAfagCfaGfcAfgGfaGfgsUfsu | 3986 |
| D-3322 | CfcUfcCfuGfcUfgCfUfugUfgGfuUfuUf | 3336 | aAfcCfaCfAfagCfaGfcAfgGfaGfgUfu | 3987 |
| D-3323 | CfcUfcCfUfgcUfgCfuUfgUfgGfuUfuUf | 3337 | aAfcCfaCfaAfgCfaGfCfagGfaGfgsUfsu | 3988 |
| D-3324 | CfcUfccUfGfcUfgCfuUfgUfgGfuUfuUf | 3338 | aAfcCfaCfaAfgCfaGfcaGfgaGfgsUfsu | 3989 |
| D-3325 | CfcUfCfcuGfcUfgCfuUfgUfgGfuUfuUf | 3339 | aAfcCfaCfaAfgCfaGfcAfGfgaGfgsUfsu | 3990 |
| D-3326 | CfcuCfCfuGfcUfgCfuUfgUfgGfuUfuUf | 3340 | aAfcCfaCfaAfgCfaGfcAfggAfGfgsUfsu | 3991 |
| D-3327 | CfCfucCfuGfcUfgCfuUfgUfgGfuUfuUf | 3341 | aAfcCfaCfaAfgCfaGfcAfgGfAfggsUfsu | 3992 |
| D-3328 | cCfUfcCfuGfcUfgCfuUfgUfgGfuUfuUf | 3342 | aAfcCfaCfaAfgCfaGfcAfgGfagGfsUfsu | 3993 |
| D-3329 | ccUfcCfuGfcUfgCfuUfgUfgGfuUfuUf | 3343 | aAfcCfaCfaAfgCfaGfcAfgGfaGfGfsusu | 3994 |
| D-3330 | CfcUfcCfuGfcUfgCfuuGfUfgGfuUfuUf | 3344 | aAfcCfacAfgCfaGfcAfgGfaGfgsUfsu | 3995 |
| D-3331 | CfcUfcCfuGfcUfgCfuUfGfugGfuUfuUf | 3345 | aAfcCfAfcaAfgCfaGfcAfgGfaGfgsUfsu | 3996 |
| D-3332 | CfcUfcCfuGfcUfgCfuUfguGfGfuUfuUf | 3346 | aAfccAfCfaAfgCfaGfcAfgGfaGfgsUfsu | 3997 |
| D-3333 | CfcUfcCfuGfcUfgCfuUfgUfGfguUfuUf | 3347 | aAfCfcaCfaAfgCfaGfcAfgGfaGfgsUfsu | 3998 |
| D-3334 | CfcUfcCfuGfcUfgCfuUfgUfggUfUfuUf | 3348 | aaCfCfaCfaAfgCfaGfcAfgGfaGfgsUfsu | 3999 |
| D-3335 | CfcUfcCfuGfcUfgCfuUfgUfgGfUfuuUf | 3349 | AfacCfaCfaAfgCfaGfcAfgGfaGfgsUfsu | 4000 |
| D-3336 | CfcUfcCfuGfcUfgCfuUfgUfgGfuuUfsUf | 3350 | AfAfcCfaCfaAfgCfaGfcAfgGfaGfgsUfsu | 4001 |
| D-3337 | CfCfucCfUfgcUfGfcuUfGfugUfUfuuUf | 3351 | AfacCfAfcaAfgCfcaGfCfagGfAfggsUfsUf | 4002 |
| D-3338 | ccUfCfcuGfCfugCfUfugUfGfguUfUfu | 3352 | aAfCfcaCfAfagCfAfgcAfGfgaGfGfsusu | 4003 |
| D-3339 | CfcuCfCfugCfUfugCfUfUfguGfGfuuUfUf | 3353 | AfAfccAfCfaaGfCfagCfAfggAfGfgsusUf | 4004 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3340 | cCfUfccUfGfcuGfCfuuGfUfggUfUfuu | 3354 | aaCfCfacAfAfgcAfGfcaGfGfagGfsUfsu | 4005 |
| D-3341 | cuAucAuGAccAAGGAGuAdTsdT | 3355 | uACUCCUUGGUcAUGAuAGdTsdT | 4006 |
| D-3342 | CfuAfuCfaUfGfAfcCfaAfgGfaGfuAfuUf | 3356 | uAfcUfcCfuUfggucaUfgAfuAfgsUfsu | 4007 |
| D-3343 | CfuAfuCfaUfGfaCfCfaAfgGfaGfuAfuUf | 3357 | uAfcUfcCfuUfggUfcaUfgAfuAfgsUfsu | 4008 |
| D-3344 | CfuAfuCfaUfgaCfCfaAfgGfaGfuAfuUf | 3358 | uAfcUfcCfuUfggUfCfaUfgAfuAfgsUfsu | 4009 |
| D-3345 | CfuAfuCfaUfgAfCfCfAfAfgGfaGfuAfuUf | 3359 | uAfcUfcCfuuggUfCfaUfgAfuAfgsUfsu | 4010 |
| D-3346 | CfuAfuCfaUfgAfCfcAfAfgGfaGfuAfuUf | 3360 | uAfcUfcCfuuGfguCfaUfgAfuAfgsUfsu | 4011 |
| D-3347 | CfuAfuCfaUfgAfCfcaAfgGfaGfuAfuUf | 3361 | uAfcUfcCfuUfGfguCfaUfgAfuAfgsUfsu | 4012 |
| D-3348 | CfuAfuCfauGfAfcCfaAfgGfaGfuAfuUf | 3362 | uAfcUfcCfuUfgGfucAfUfgAfuAfgsUfsu | 4013 |
| D-3349 | CfuAfuCfaUfgAfcCfAfagGfaGfuAfuUf | 3363 | uAfcUfcCfuUfugGfuCfaUfgAfuAfgsUfsu | 4014 |
| D-3350 | CfsusAfuCfauGfAfcCfaAfgGfaGfuAfuUf | 3364 | usAfscUfcCfuUfgGfucAfUfgAfuAfgsUfsu | 4015 |
| D-3351 | CfuAfuCfauGfAfcCfaAfgGfaGfuAfuUf | 3365 | uAfcUfcCfuUfgGfucAfUfgAfuAfgUfu | 4016 |
| D-3352 | CfsusAfuCfaUfgAfcCfAfagGfaGfuAfuUf | 3366 | usAfscUfcCfUfUfugGfuCfaUfgAfuAfgsUfsu | 4017 |
| D-3353 | CfuAfuCfaUfgAfcCfAfagGfaGfuAfuUf | 3367 | uAfcUfcCfUfUfugGfuCfaUfgAfuAfgUfu | 4018 |
| D-3354 | CfuAfuCfAfugAfcCfaAfgGfaGfuAfuUf | 3368 | uAfcUfcCfuUfgGfuCfAfugAfuAfgsUfsu | 4019 |
| D-3355 | CfuAfucAfUfgAfcCfaAfgGfaGfuAfuUf | 3369 | uAfcUfcCfuUfgGfuCfauGfAfuAfgsUfsu | 4020 |
| D-3356 | CfuAfUfcaUfgAfcCfaAfgGfaGfuAfuUf | 3370 | uAfcUfcCfuUfgGfuCfaUfGfauAfgsUfsu | 4021 |
| D-3357 | CfuaUfCfaUfgAfcCfaAfgGfaGfuAfuUf | 3371 | uAfcUfcCfuUfgGfuCfaUfgaUfAfgsUfsu | 4022 |
| D-3358 | CfUfauCfaUfgAfcCfaAfgGfaGfuAfuUf | 3372 | uAfcUfcCfuUfgGfuCfaUfgAfUfagsUfsu | 4023 |
| D-3359 | cUfAfuCfaUfgAfcCfaAfgGfaGfuAfuUf | 3373 | uAfcUfcCfuUfgGfuCfaUfgAfuaGfsUfsu | 4024 |
| D-3360 | cuAfuCfaUfgAfcCfaAfgGfaGfuAfuUf | 3374 | uAfcUfcCfuUfgGfuCfaUfgAfuAfGfsusu | 4025 |
| D-3361 | CfuAfuCfaUfgAfcCfaaGfGfaGfuAfuUf | 3375 | uAfcUfccUfUfgGfuCfaUfgAfuAfgsUfsu | 4026 |
| D-3362 | CfuAfuCfaUfgAfcCfaAfGfgaGfuAfuUf | 3376 | uAfcUfCfcuUfgGfuCfaUfgAfuAfgsUfsu | 4027 |
| D-3363 | CfuAfuCfaUfgAfcCfaAfggAfGfuAfuUf | 3377 | uAfcuCfCfuUfgGfuCfaUfgAfuAfgsUfsu | 4028 |
| D-3364 | CfuAfuCfaUfgAfcCfaAfgGfAfguAfuUf | 3378 | uAfCfucCfuUfgGfuCfaUfgAfuAfgsUfsu | 4029 |
| D-3365 | CfuAfuCfaUfgAfcCfaAfgGfagUfAfuUf | 3379 | uaCfUfcCfuUfgGfuCfaUfgAfuAfgsUfsu | 4030 |
| D-3366 | CfuAfuCfaUfgAfcCfaAfgGfaGfUfauUf | 3380 | UfacUfcCfuUfgGfuCfaUfgAfuAfgsUfsu | 4031 |
| D-3367 | CfuAfuCfaUfgAfcCfaAfgGfaGfuaUfUf | 3381 | UfAfcUfcCfuUfgGfuCfaUfgAfuAfgsUfsu | 4032 |
| D-3368 | CfUfauCfAfugAfCfcaAfGfgaGfUfauUf | 3382 | UfacUfCfcuUfGfguCfAfugAfUfagsUfsUf | 4033 |
| D-3369 | cuAfUfcaUfGfacCfAfagGfAfguAfUfu | 3383 | uAfcUfccCfUfugGfUfucaUfgAfuAfGfsusu | 4034 |
| D-3370 | CfuaUfCfauGfAfccAfAfggAfGfuaUfUf | 3384 | UfAfcuCfCfuuGfGfucAfUfgaUfAfgsusUf | 4035 |
| D-3371 | cUfAfucAfUfgaCfCfaaGfGfagUfAfuu | 3385 | uaCfUfccUfUfggUfCfauGfAfuaGfsUfsu | 4036 |
| D-3372 | cGuccuGGGAGGAGcAGAAdTsdT | 3386 | UUCUGCUCCUCCcAGGACGdTsdT | 4037 |
| D-3373 | CfgUfcCfuGfGfGfAfGfgAfgCfaGfaAfuUf | 3387 | uUfcUfgCfuCfcucccAfgGfaCfgsUfsu | 4038 |
| D-3374 | CfgUfcCfuGfGfgAfGfgAfgCfaGfaAfuUf | 3388 | uUfcUfgCfuCfCfcuCfccAfgGfaCfgsUfsu | 4039 |
| D-3375 | CfgUfcCfuGfggAfGfgAfgCfaGfaAfuUf | 3389 | uUfcUfgCfuCfCfcuCfCfcAfgGfaCfgsUfsu | 4040 |
| D-3376 | CfgUfcCfuGfgGfAfGfGfAfgCfaGfaAfuUf | 3390 | uUfcUfgCfuccucCfcAfgGfaCfgsUfsu | 4041 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3377 | CfgUfcCfuGfgGfAfgGfAfgCfaGfaAfuUf | 3391 | uUfcUfgCfucCfucCfcAfgGfaCfgsUfsu | 4042 |
| D-3378 | CfgUfcCfuGfgGfAfggAfgCfaGfaAfuUf | 3392 | uUfcUfgCfuCfCfucCfcAfgGfaCfgsUfsu | 4043 |
| D-3379 | CfgUfcCfugGfGfaGfgAfgCfaGfaAfuUf | 3393 | uUfcUfgCfuCfcUfccCfAfgGfaCfgsUfsu | 4044 |
| D-3380 | CfgUfcCfuGfgGfaGfGfagCfaGfaAfuUf | 3394 | uUfcUfgCfUfccUfcCfcAfgGfaCfgsUfsu | 4045 |
| D-3381 | CfsgsUfcCfugGfgfaGfgAfgCfaGfaAfuUf | 3395 | usUfscUfgCfuCfcUfccCfAfgGfaCfgsUfsu | 4046 |
| D-3382 | CfgUfcCfugGfGfaGfgAfgCfaGfaAfuUf | 3396 | uUfcUfgCfuCfcUfccCfAfgGfaCfgUfu | 4047 |
| D-3383 | CfsgsUfcCfuGfgGfaGfGfagCfaGfaAfuUf | 3397 | usUfscUfgCfUfccUfcCfcAfgGfaCfgsUfsu | 4048 |
| D-3384 | CfgUfcCfuGfgGfaGfGfagCfaGfaAfuUf | 3398 | uUfcUfgCfUfccUfcCfcAfgGfaCfgUfu | 4049 |
| D-3385 | CfgUfcCfUfggGfaGfgAfgCfaGfaAfuUf | 3399 | uUfcUfgCfuCfcUfcCfCfagGfaCfgsUfsu | 4050 |
| D-3386 | CfgUfccUfGfgGfaGfgAfgCfaGfaAfuUf | 3400 | uUfcUfgCfuCfcUfcCfcaGfGfaCfgsUfsu | 4051 |
| D-3387 | CfgUfCfcuGfgGfaGfgAfgCfaGfaAfuUf | 3401 | uUfcUfgCfuCfcUfcCfcAfGfgaCfgsUfsu | 4052 |
| D-3388 | CfguCfCfuGfgGfaGfgAfgCfaGfaAfuUf | 3402 | uUfcUfgCfuCfcUfcCfcAfggAfCfgsUfsu | 4053 |
| D-3389 | CfGfucCfuGfgGfaGfgAfgCfaGfaAfuUf | 3403 | uUfcUfgCfuCfcUfcCfcAfgGfAfcgsUfsu | 4054 |
| D-3390 | cGfUfcCfuGfgGfaGfgAfgCfaGfaAfuUf | 3404 | uUfcUfgCfuCfcUfcCfcAfgGfacGfsUfsu | 4055 |
| D-3391 | cgUfcCfuGfgGfaGfgAfgCfaGfaAfuUf | 3405 | uUfcUfgCfuCfcUfcCfcAfgGfaCfGfsusu | 4056 |
| D-3392 | CfgUfcCfuGfgGfaGfgaGfCfaGfaAfuUf | 3406 | uUfcUfgcUfCfcUfcCfcAfgGfaCfgsUfsu | 4057 |
| D-3393 | CfgUfcCfuGfgGfaGfgAfGfcaGfaAfuUf | 3407 | uUfcUfGfcuCfcUfcCfcAfgGfaCfgsUfsu | 4058 |
| D-3394 | CfgUfcCfuGfgGfaGfgAfgcAfGfaAfuUf | 3408 | uUfcuGfcUfcUfcCfcAfgGfaCfgsUfsu | 4059 |
| D-3395 | CfgUfcCfuGfgGfaGfgAfgCfAfgaAfuUf | 3409 | uUfCfugCfuCfcUfcCfcAfgGfaCfgsUfsu | 4060 |
| D-3396 | CfgUfcCfuGfgGfaGfgAfgCfagAfAfuUf | 3410 | uuCfUfgCfuCfcUfcCfcAfgGfaCfgsUfsu | 4061 |
| D-3397 | CfgUfcCfuGfgGfaGfgAfgCfaGfAfauUf | 3411 | UfucUfgCfuCfcUfcCfcAfgGfaCfgsUfsu | 4062 |
| D-3398 | CfgUfcCfuGfgGfaGfgAfgCfaGfaaUfUf | 3412 | UfUfcUfgCfuCfcUfcCfcAfgGfaCfgsUfsu | 4063 |
| D-3399 | CfGfucCfUfggGfAfggAfGfcaGfAfauUf | 3413 | UfucUfGfcuCfUfccCfCfagGfAfcgsUfsUf | 4064 |
| D-3400 | cgUfcCfcuGfGfgaGfGfagCfAfgaAfUfu | 3414 | uUfCfugCfUfccUfCfccAfGfgaCfGfsusu | 4065 |
| D-3401 | CfguCfCfugGfGfagGfAfgcAfGfaaUfUf | 3415 | UfUfcuGfCfucCfUfccCfAfggAfCfgsusUf | 4066 |
| D-3402 | cGfUfccUfGfggAfGfgaGfCfagAfAfuu | 3416 | uuCfUfgcUfcUfcCfcCfcaGfGfacGfsUfsu | 4067 |
| D-3403 | cuGGGGGccucuucuGcuudTsdT | 3417 | AAGcAGAAGAGGCCCCcAGdTsdT | 4068 |
| D-3404 | CfuGfgGfgGfCfCfUfcfuUfcUfgCfuUfuUf | 3418 | aAfgCfaGfaAfgaggcCfcCfcCfAfgsUfsu | 4069 |
| D-3405 | CfuGfgGfgGfCfcUfCfuUfcUfgCfuUfuUf | 3419 | aAfgCfaGfaAfgaGfgcCfcCfcAfgsUfsu | 4070 |
| D-3406 | CfuGfgGfgGfccUfCfuUfcUfgCfuUfuUf | 3420 | aAfgCfaGfaAfgaGfGfcCfcCfcCfAfgsUfsu | 4071 |
| D-3407 | CfuGfgGfgGfcCfUfcfUfUfcUfgCfuUfuUf | 3421 | aAfgCfaGfaagagGfcCfcCfcCfAfgsUfsu | 4072 |
| D-3408 | CfuGfgGfgGfcCfUfcUfUfcUfgCfuUfuUf | 3422 | aAfgCfaGfaaGfagGfcCfcCfcAfgsUfsu | 4073 |
| D-3409 | CfuGfgGfgGfcCfUfcuUfcUfgCfuUfuUf | 3423 | aAfgCfaGfaAfGfagGfcCfcCfcAfgsUfsu | 4074 |
| D-3410 | CfuGfgGfggCfCfcUfcUfcUfgCfuUfuUf | 3424 | aAfgCfaGfaAfgAfggCfcCfcCfcAfgsUfsu | 4075 |
| D-3411 | CfuGfgGfgGfcCfuCfUfucUfgCfuUfuUf | 3425 | aAfgCfaGfAfagAfgGfcCfcCfcAfgsUfsu | 4076 |
| D-3412 | CfsusGfgGfggCfCfuCfcUfcUfgCfuUfuUf | 3426 | asAfsgCfaGfaAfgAfggCfcCfcCfAfgsUfsu | 4077 |
| D-3413 | CfuGfgGfggCfCfuCfcUfcUfcUfgCfuUfuUf | 3427 | aAfgCfaGfaAfgAfggGfCfcCfcCfcAfgUfu | 4078 |
| D-3414 | CfsusGfgGfgGfcCfuCfUfucUfgCfuUfuUf | 3428 | asAfsgCfaGfAfagAfgGfcCfcCfcAfgsUfsu | 4079 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3415 | CfuGfgGfgGfccCfuCfUfucUfgCfuUfuUf | 3429 | aAfgCfaGfAfagAfgGfcCfcCfcAfgUfu | 4080 |
| D-3416 | CfuGfgGfGfgcCfuCfuUfcUfgCfuUfuUf | 3430 | aAfgCfaGfaAfgAfgGfCfccCfcAfgsUfsu | 4081 |
| D-3417 | CfuGfggGfcCfuCfuUfcUfgCfuUfuUf | 3431 | aAfgCfaGfaAfgAfgGfccCfCfcAfgsUfsu | 4082 |
| D-3418 | CfuGfGfggGfcCfuCfuUfcUfgCfuUfuUf | 3432 | aAfgCfaGfaAfgAfgAfgcCfCfccAfgsUfsu | 4083 |
| D-3419 | CfugGfGfgGfcCfuCfuUfcUfgCfuUfuUf | 3433 | aAfgCfaGfaAfgAfgGfcCfccCfAfgsUfsu | 4084 |
| D-3420 | CfUfggGfgGfcCfuCfuUfcUfgCfuUfuUf | 3434 | aAfgCfaGfaAfgAfgGfcCfcCfCfagsUfsu | 4085 |
| D-3421 | cUfGfgGfgGfcCfuCfuUfcUfgCfuUfuUf | 3435 | aAfgCfaGfaAfgAfgGfcCfcCfcaGfsUfsu | 4086 |
| D-3422 | cuGfgGfgGfcCfuCfuUfcUfgCfuUfuUf | 3436 | aAfgCfaGfaAfgAfgGfcCfcCfcAfGfsusu | 4087 |
| D-3423 | CfuGfgGfgGfcCfuCfuuCfUfgCfuUfuUf | 3437 | aAfgCfagAfAfgAfgGfcCfcCfcAfgsUfsu | 4088 |
| D-3424 | CfuGfgGfgGfcCfuCfuUfCfugCfuUfuUf | 3438 | aAfgCfAfgaAfgAfgGfcCfcCfcAfgsUfsu | 4089 |
| D-3425 | CfuGfgGfgGfcCfuCfuUfcuGfCfuUfuUf | 3439 | aAfgcAfGfaAfgAfgGfcCfcCfcAfgsUfsu | 4090 |
| D-3426 | CfuGfgGfgGfcCfuCfuUfcUfGfcuUfuUf | 3440 | aAfGfcaGfaAfgAfgGfcCfcCfcAfgsUfsu | 4091 |
| D-3427 | CfuGfgGfgGfcCfuCfuUfcUfgcUfuUfuUf | 3441 | aaGfCfaGfaAfgAfgGfcCfcCfcAfgsUfsu | 4092 |
| D-3428 | CfuGfgGfgGfcCfuCfuUfcUfgCfUfuuUf | 3442 | AfagCfaGfaAfgAfgGfcCfcCfcAfgsUfsu | 4093 |
| D-3429 | CfuGfgGfgGfcCfuCfuUfcUfgCfuuUfUf | 3443 | AfAfgCfaGfaAfgAfgGfcCfcCfcAfgsUfsu | 4094 |
| D-3430 | CfUfggGfGfgcCfUfcuUfCfugCfUfuuUf | 3444 | AfagCfAfgaAfGfagGfCfccCfCfagsUfsUf | 4095 |
| D-3431 | cuGfGfggGfCfcuCfUfucUfGfcuUfUfu | 3445 | aAfGfcaGfAfagAfGfgcCfCfccAfGfsusu | 4096 |
| D-3432 | CfugGfGfggCfCfucUfUfcuGfCfuuUfUf | 3446 | AfAfgcAfGfaaGfAfggCfCfccCfAfgsusUf | 4097 |
| D-3433 | cUfGfggGfCfccUfCfuuCfUfgcUfUfuu | 3447 | aaGfCfagAfAfgaGfCfccCfCfcaGfsUfsu | 4098 |
| D-3434 | ccuAucAuGAccAAGGAGudTsdT | 3448 | ACUCCUUGGUcAUGAuAGGdTsdT | 4099 |
| D-3435 | CfcUfaUfcAfUfGfAfCfcAfaGfAfgUfuUf | 3449 | aCfuCfcUfuGfgucauGfaUfaGfgsUfsu | 4100 |
| D-3436 | CfcUfaUfcAfUfgAfCfcAfaGfgAfgUfuUf | 3450 | aCfuCfcUfuGfguCfauGfaUfaGfgsUfsu | 4101 |
| D-3437 | CfcUfaUfcAfugaAfCfaGfgAfgUfuUf | 3451 | aCfuCfcUfuGfguCfAfuGfaUfaGfgsUfsu | 4102 |
| D-3438 | CfcUfaUfcAfuGfAfCfCfaGfgAfgUfuUf | 3452 | aCfuCfcUfugguCfAfuGfaUfaGfgsUfsu | 4103 |
| D-3439 | CfcUfaUfcAfuGfAfccCfaGfgAfgUfuUf | 3453 | aCfuCfcUfugGfucAfuGfaUfaGfgsUfsu | 4104 |
| D-3440 | CfcUfaUfcAfuGfAfccAfaGfgAfgUfuUf | 3454 | aCfuCfcUfuGfGfucAfuGfaUfaGfgsUfsu | 4105 |
| D-3441 | CfcUfaUfcaUfgfaCfcAfaGfgAfgUfuUf | 3455 | aCfuCfcUfuGfgUfcaUfgAfUfaGfgsUfsu | 4106 |
| D-3442 | CfcUfaUfcAfuGfacCfaaGfgAfgUfuUf | 3456 | aCfuCfcUfUfggUfcAfuGfaUfaGfgsUfsu | 4107 |
| D-3443 | CfscsUfaUfcaUfGfaCfcAfaGfgAfgUfuUf | 3457 | asCfsuCfcUfuGfgUfcaUfGfaUfaGfgsUfsu | 4108 |
| D-3444 | CfcUfaUfcaUfGfaCfcAfaGfgAfgUfuUf | 3458 | aCfuCfcUfuGfgUfcaUfGfaUfaGfgUfu | 4109 |
| D-3445 | CfscsUfaUfcAfuGfaCfCfaaGfgAfgUfuUf | 3459 | asCfsuCfcUfUfggUfcAfuGfaUfaGfgsUfsu | 4110 |
| D-3446 | CfcUfaUfcAfuGfaCfCfaaGfgAfgUfuUf | 3460 | aCfuCfcUfUfggUfcAfuGfaUfaGfgUfu | 4111 |
| D-3447 | CfcUfaUfCfauGfaCfcAfaGfgAfgUfuUf | 3461 | aCfuCfcUfuGfUfcAfUfgaUfaGfgsUfsu | 4112 |
| D-3448 | CfcUfauCfAfuGfaCfcAfaGfgAfgUfuUf | 3462 | aCfuCfcUfuGfgUfcAfugAfUfaGfgsUfsu | 4113 |
| D-3449 | CfcUfAfucAfuGfaCfcAfaGfgAfgUfuUf | 3463 | aCfuCfcUfuGfgUfcAfuGfAfuaGfgsUfsu | 4114 |
| D-3450 | CfcuAfUfcAfuGfaCfcAfaGfgAfgUfuUf | 3464 | aCfuCfcUfuGfgUfcAfuGfauAfGfgsUfsu | 4115 |
| D-3451 | CfCfuaUfcAfuGfaCfcAfaGfgAfgUfuUf | 3465 | aCfuCfcUfuGfgUfcAfuGfaUfAfggsUfsu | 4116 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3452 | cCfUfaUfcAfuGfaCfcAfaGfgAfgUfuUf | 3466 | aCfuCfcUfuGfgUfcAfuGfaUfagGfsUfsu | 4117 |
| D-3453 | ccUfaUfcAfuGfaCfcAfaGfgAfgUfuUf | 3467 | aCfuCfcUfuGfgUfcAfuGfaUfaGfGfsusu | 4118 |
| D-3454 | CfcUfaUfcAfuGfaCfcaAfgGfgAfgUfuUf | 3468 | aCfuCfcuUfGfgUfcAfuGfaUfaGfgsUfsu | 4119 |
| D-3455 | CfcUfaUfcAfuGfaCfcAfAfggAfgUfuUf | 3469 | aCfuCfCfuuGfgUfcAfuGfaUfaGfgsUfsu | 4120 |
| D-3456 | CfcUfaUfcAfuGfaCfcAfagGfAfgUfuUf | 3470 | aCfucCfuUfuGfgUfcAfuGfaUfaGfgsUfsu | 4121 |
| D-3457 | CfcUfaUfcAfuGfaCfcAfaGfGfagUfuUf | 3471 | aCfUfccUfuGfgUfcAfuGfaUfaGfgsUfsu | 4122 |
| D-3458 | CfcUfaUfcAfuGfaCfcAfaGfgaGfUfuUf | 3472 | acUfCfcUfuGfgUfcAfuGfaUfaGfgsUfsu | 4123 |
| D-3459 | CfcUfaUfcAfuGfaCfcAfaGfgAfGfuuUf | 3473 | AfcuCfcUfuGfgUfcAfuGfaUfaGfgsUfsu | 4124 |
| D-3460 | CfcUfaUfcAfuGfaCfcAfaGfgAfguUfUf | 3474 | AfCfuCfcUfuGfgUfcAfuGfaUfaGfgsUfsu | 4125 |
| D-3461 | CfCfuaUfCfauGfAfccAfAfggAfgGfuuUf | 3475 | AfcuCfCfuuGfGfucAfUfgaUfAfggsUfsUf | 4126 |
| D-3462 | ccUfAfucAfUfgaCfCfaaGfGfagUfUfu | 3476 | aCfUfccUfUfggUfCfauGfAfuaGfGfsusu | 4127 |
| D-3463 | CfcuAfUfcaUfgacCfAfagGfAfguUfUf | 3477 | AfCfucCfUfugGfUfcaUfGfauAfGfgsusUf | 4128 |
| D-3464 | cCfUfauCfAfugaAfCfcaAfGfgaGfUfuu | 3478 | acUfCfcuUfGfguCfAfugAfUfagGfsUfsu | 4129 |
| D-3465 | uGuGGGAAGAAAGAuGAAGdTsdT | 3479 | CUUcAUCUUUCUUCCcAcAdTsdT | 4130 |
| D-3466 | UfgUfgGfgAfAfGfAfaGfaUfgAfaGfuUf | 3480 | cUfuCfaUfcUfuucuuCfcCfaCfasUfsu | 4131 |
| D-3467 | UfgUfgGfgAfAfgAfAfaGfaUfgAfaGfuUf | 3481 | cUfuCfaUfcUfuuCfuuCfcCfaCfasUfsu | 4132 |
| D-3468 | UfgUfgGfgAfagAfAfaGfaUfgAfaGfuUf | 3482 | cUfuCfaUfcUfuuCfUfuCfcCfaCfasUfsu | 4133 |
| D-3469 | UfgUfgGfgAfaGfAfAfAfGfaUfgAfaGfuUf | 3483 | cUfuCfaUfcuuucUfuCfcCfaCfasUfsu | 4134 |
| D-3470 | UfgUfgGfgAfaGfAfaAfGfaUfgAfaGfuUf | 3484 | cUfuCfaUfcuUfucUfuCfcCfaCfasUfsu | 4135 |
| D-3471 | UfgUfgGfgAfaGfAfaaGfaUfgAfaGfuUf | 3485 | cUfuCfaUfcUfUfucUfuCfcCfaCfasUfsu | 4136 |
| D-3472 | UfgUfgGfgaAfGfaAfaGfaUfgAfaGfuUf | 3486 | cUfuCfaUfcUfuUfcuUfCfcCfaCfasUfsu | 4137 |
| D-3473 | UfgUfgGfgAfaGfaAfAfgaUfgAfaGfuUf | 3487 | cUfuCfaUfCfuuUfcUfuCfcCfaCfasUfsu | 4138 |
| D-3474 | UfsgsUfgGfgaAfGfaAfaGfaUfgAfaGfuUf | 3488 | csUfsuCfaUfcUfuUfcuUfCfcCfaCfasUfsu | 4139 |
| D-3475 | UfgUfgGfgaAfGfaAfaGfaUfgAfaGfuUf | 3489 | cUfuCfaUfcUfuUfcuUfCfcCfaCfaUfu | 4140 |
| D-3476 | UfsgsUfgGfgAfaGfaAfAfgaUfgAfaGfuUf | 3490 | csUfsuCfaUfCfuuUfcUfuCfcCfaCfasUfsu | 4141 |
| D-3477 | UfgUfgGfgAfaGfaAfAfgaUfgAfaGfuUf | 3491 | cUfuCfaUfCfuuUfcUfuCfcCfaCfaUfu | 4142 |
| D-3478 | UfgUfgGfGfaaGfaAfaGfaUfgAfaGfuUf | 3492 | cUfuCfaUfcUfuUfcUfUfccCfaCfasUfsu | 4143 |
| D-3479 | UfgUfggGfAfaGfaAfaGfaUfgAfaGfuUf | 3493 | cUfuCfaUfcUfuUfcUfucCfaCfasUfsu | 4144 |
| D-3480 | UfgUfGfggAfaGfaAfaGfaUfgAfaGfuUf | 3494 | cUfuCfaUfcUfuUfcUfuCfCfcaCfasUfsu | 4145 |
| D-3481 | UfguGfUfgAfaGfaAfaGfaUfgAfaGfuUf | 3495 | cUfuCfaUfcUfuUfcUfuCfccAfCfasUfsu | 4146 |
| D-3482 | UfGfugGfgAfaGfaAfaGfaUfgAfaGfuUf | 3496 | cUfuCfaUfcUfuUfcUfuCfuCfCfAfcasUfsu | 4147 |
| D-3483 | uGfUfgGfgAfaGfaAfaGfaUfgAfaGfuUf | 3497 | cUfuCfaUfcUfuUfcUfuCfcCfacAfsUfsu | 4148 |
| D-3484 | ugUfgGfgAfgfaAfaGfaUfgAfaGfuUf | 3498 | cUfuCfaUfcUfuUfcUfuCfcCfaCfAfsusu | 4149 |
| D-3485 | UfgUfgGfgAfaGfaAfagAfUfgAfaGfuUf | 3499 | cUfuCfauCfUfuUfcUfuCfCfaCfasUfsu | 4150 |
| D-3486 | UfgUfgGfgAfaGfaAfaGfAfugAfaGfuUf | 3500 | cUfuCfAfucUfuUfcUfuCfcCfaCfasUfsu | 4151 |
| D-3487 | UfgUfgGfgAfaGfaAfaGfaUfGfaAfaGfuUf | 3501 | cUfucAfUfcUfuUfcUfuCfCfaCfasUfsu | 4152 |
| D-3488 | UfgUfgGfgAfaGfaAfaGfaUfGfaaGfuUf | 3502 | cUfUfcaUfcUfuUfcUfuCfcCfaCfasUfsu | 4153 |
| D-3489 | UfgUfgGfgAfaGfaAfaGfaUfgaAfGfuUf | 3503 | cuUfCfaUfcUfuUfcUfuCfcCfaCfasUfsu | 4154 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3490 | UfgUfgGfgAfaGfaAfaGfaUfgAfAfguUf | 3504 | CfuuCfaUfcUfuUfcUfuCfcCfaCfasUfsu | 4155 |
| D-3491 | UfgUfgGfgAfaGfaAfaGfaUfgAfagUfUf | 3505 | CfUfuCfaUfcUfuUfcUfuCfcCfaCfasUfsu | 4156 |
| D-3492 | UfGfugGfGfaaGfAfaaGfAfugAfAfguUf | 3506 | CfuuCfAfucUfUfucUfUfccCfAfcasUfsUf | 4157 |
| D-3493 | ugUfGfggAfAfgaAfAfgaUfGfaaGfUfu | 3507 | cUfUfcaUfCfuuUfCfuuCfCfcaCfAfsusu | 4158 |
| D-3494 | UfguGfGfgaAfGfaaAfGfauGfAfagUfUf | 3508 | CfUfucAfUfcuUfUfcuUfCfccAfCfasusUf | 4159 |
| D-3495 | uGfUfggGfAfagAfAfagAfUfgaAfGfuu | 3509 | cuUfCfauCfUfuuCfUfucCfCfacAfsUfsu | 4160 |
| D-3496 | AGGAcuGuGcccAcuucAcdTsdT | 3510 | GUGAAGUGGGcAcAGUCCUdTsdT | 4161 |
| D-3497 | AfgGfaCfuGfUfGfCfCfcAfcUfuCfaCfuUf | 3511 | gUfgAfaGfuGfggcacAfgUfcCfusUfsu | 4162 |
| D-3498 | AfgGfaCfuGfUfgCfCfcAfcUfuCfaCfuUf | 3512 | gUfgAfaGfuGfggCfacAfgUfcCfusUfsu | 4163 |
| D-3499 | AfgGfaCfuGfugCfCfcAfcUfuCfaCfuUf | 3513 | gUfgAfaGfuGfggCfAfcAfgUfcCfusUfsu | 4164 |
| D-3500 | AfgGfaCfuGfuGfCfCfcAfcUfuCfaCfuUf | 3514 | gUfgAfaGfugggCfAfcAfgUfcCfusUfsu | 4165 |
| D-3501 | AfgGfaCfuGfuGfCfcAfcUfuCfaCfuUf | 3515 | gUfgAfaGfuGfgcAfcAfgUfcCfusUfsu | 4166 |
| D-3502 | AfgGfaCfuGfuGfCfccAfcUfuCfaCfuUf | 3516 | gUfgAfaGfuGfGfgcAfcAfgUfcCfusUfsu | 4167 |
| D-3503 | AfgGfaCfugUfGfccCfcAfcUfuCfaCfuUf | 3517 | gUfgAfaGfuGfgGfcaCfAfgUfcCfusUfsu | 4168 |
| D-3504 | AfgGfaCfuGfuGfccCffacUfuCfaCfuUf | 3518 | gUfgAfaGfUfggGfcAfcAfgUfcCfusUfsu | 4169 |
| D-3505 | AfsgsGfaCfugUfGfcCfcAfcUfuCfaCfuUf | 3519 | gsUfsgAfaGfuGfGfcaCfAfgUfcCfusUfsu | 4170 |
| D-3506 | AfgGfaCfugUfGfccCfcAfcUfuCfaCfuUf | 3520 | gUfgAfaGfuGfGfcaCfAfgUfcCfuUfu | 4171 |
| D-3507 | AfsgsGfaCfugUfGfuGfCfCfacUfuCfaCfuUf | 3521 | gsUfsgAfaGfUfggGfcAfcAfgUfcCfusUfsu | 4172 |
| D-3508 | AfgGfaCfuGfuGfccCfCfacUfuCfaCfuUf | 3522 | gUfgAfaGfUfggGfcAfcAfgUfcCfuUfu | 4173 |
| D-3509 | AfgGfaCfUfguGfccCfcAfcUfuCfaCfuUf | 3523 | gUfgAfaGfuGfgGfcAfCfagUfcCfusUfsu | 4174 |
| D-3510 | AfgGfacUfGfuGfccCfcAfcUfuCfaCfuUf | 3524 | gUfgAfaGfuGfgGfcAfcaGfuCfcCfusUfsu | 4175 |
| D-3511 | AfgGfAfcuGfuGfccCfcAfcUfuCfaCfuUf | 3525 | gUfgAfaGfuGfgGfcAfcAfGfucCfusUfsu | 4176 |
| D-3512 | AfggAfCfuGfuGfccCfcAfcUfuCfaCfuUf | 3526 | gUfgAfaGfuGfgGfcAfcAfguCfCfusUfsu | 4177 |
| D-3513 | AfGfgaCfuGfuGfccCfcAfcUfuCfaCfuUf | 3527 | gUfgAfaGfuGfgGfcAfcAfgUfCfcusUfsu | 4178 |
| D-3514 | aGfGfaCfuGfuGfccCfcAfcUfuCfaCfuUf | 3528 | gUfgAfaGfuGfgGfcAfcAfgUfccUfsfsu | 4179 |
| D-3515 | agGfaCfuGfuGfcCfcAfcUfuCfaCfuUf | 3529 | gUfgAfaGfuGfgGfcAfcAfgUfcCfUfsusu | 4180 |
| D-3516 | AfgGfaCfuGfuGfccCfcaCfUfuCfaCfuUf | 3530 | gUfgAfagUfGfgGfcAfcAfgUfcCfusUfsu | 4181 |
| D-3517 | AfgGfaCfuGfuGfccCfcAfCfuuCfaCfuUf | 3531 | gUfgAfAfguGfgGfcAfcAfgUfcCfusUfsu | 4182 |
| D-3518 | AfgGfaCfuGfuGfccCfcAfcuUfCfaCfuUf | 3532 | gUfgaAfGfuGfgGfcAfcAfgUfcCfusUfsu | 4183 |
| D-3519 | AfgGfaCfuGfuGfccCfcAfcUfUfcaCfuUf | 3533 | gUfGfaaGfuGfgGfcAfcAfgUfcCfusUfsu | 4184 |
| D-3520 | AfgGfaCfuGfuGfccCfcAfcUfucAfCfuUf | 3534 | guGfAfaGfuGfgGfcAfcAfgUfcCfusUfsu | 4185 |
| D-3521 | AfgGfaCfuGfuGfccCfcAfcUfuCfAfcuUf | 3535 | GfugAfaGfuGfgGfcAfcAfgUfcCfusUfsu | 4186 |
| D-3522 | AfgGfaCfuGfuGfccCfcAfcUfuCfacUfUf | 3536 | GfUfgAfaGfuGfgGfcAfcAfgUfcCfusUfsu | 4187 |
| D-3523 | AfGfgaCfUfguGfccAfCfuuCfAfcuUf | 3537 | GfugAfAfguGfgGfgcAfCfagUfCfcusUfsUf | 4188 |
| D-3524 | agGfAfcuGfUfgcCfCfcAfcUfUfcaCfUfu | 3538 | gUfGfaaGfUfggGfCfacAfGfuccCfUfsusu | 4189 |
| D-3525 | AfggAfCfugUfGfccCfAfcuUfCfacUfUf | 3539 | GfUfgaAfGfugGfGfcaCfAfgucCfCfususUf | 4190 |
| D-3526 | aGfGfacUfGfugCfCfcaCfUfucAfCfuu | 3540 | guGfAfagUfGfggCfAfcaGfUfccUfsfsu | 4191 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3527 | GAuAGGGuGAuGuuccGAAdTsdT | 3541 | UUCGGAAcAUcACCCuAUCdTsdT | 4192 |
| D-3528 | GfaUfaGfgGfUfGfAfUfgUfuCfcGfaAfuUf | 3542 | uUfcGfgAfaCfaucacCfcUfaUfcsUfsu | 4193 |
| D-3529 | GfaUfaGfgGfUfgAfUfgUfuCfcGfaAfuUf | 3543 | uUfcGfgAfaCfauCfacCfcUfaUfcsUfsu | 4194 |
| D-3530 | GfaUfaGfgGfugAfUfgUfuCfcGfaAfuUf | 3544 | uUfcGfgAfaCfauCfAfcCfcUfaUfcsUfsu | 4195 |
| D-3531 | GfaUfaGfgGfuGfAfUfGfUfuCfcGfaAfuUf | 3545 | uUfcGfgAfacaucAfcCfcUfaUfcsUfsu | 4196 |
| D-3532 | GfaUfaGfgGfuGfAfuGfUfuCfcGfaAfuUf | 3546 | uUfcGfgAfacAfucAfcCfcUfaUfcsUfsu | 4197 |
| D-3533 | GfaUfaGfgGfuGfAfugUfuCfcGfaAfuUf | 3547 | uUfcGfgAfaCfAfucAfcCfcUfaUfcsUfsu | 4198 |
| D-3534 | GfaUfaGfggUfGfaUfgUfuCfcGfaAfuUf | 3548 | uUfcGfgAfaCfaUfcaCfcCfcUfaUfcsUfsu | 4199 |
| D-3535 | GfaUfaGfgGfuGfaUfGfuuCfcGfaAfuUf | 3549 | uUfcGfgAfAfcaUfcAfcCfcUfaUfcsUfsu | 4200 |
| D-3536 | GfsasUfaGfggUfGfaUfgUfuCfcGfaAfuUf | 3550 | usUfscGfgAfaCfaUfcaCfcCfcUfaUfcsUfsu | 4201 |
| D-3537 | GfaUfaGfggUfGfaUfgUfuCfcGfaAfuUf | 3551 | uUfcGfgAfaCfaUfcaCfcCfcUfaUfcUfu | 4202 |
| D-3538 | GfsasUfaGfgGfuGfaUfGfuuCfcGfaAfuUf | 3552 | usUfscGfgAfaCfAfcaUfcAfcCfcUfaUfcsUfsu | 4203 |
| D-3539 | GfaUfaGfgGfuGfaUfGfuuCfcGfaAfuUf | 3553 | uUfcGfgAfAfcaUfcAfcCfcUfaUfcUfu | 4204 |
| D-3540 | GfaUfaGfgGfguGfaUfgUfuCfcGfaAfuUf | 3554 | uUfcGfgAfaCfaUfcAfCfccUfaUfcsUfsu | 4205 |
| D-3541 | GfaUfagGfGfuGfaUfgUfuCfcGfaAfuUf | 3555 | uUfcGfgAfaCfaUfcAfccCfUfaUfcsUfsu | 4206 |
| D-3542 | GfaUfAfggGfuGfaUfgUfuCfcGfaAfuUf | 3556 | uUfcGfgAfaCfaUfcAfcCfCfuaUfcsUfsu | 4207 |
| D-3543 | GfauAfGfgGfuGfaUfgUfuCfcGfaAfuUf | 3557 | uUfcGfgAfaCfaUfcAfcCfcuAfUfcsUfsu | 4208 |
| D-3544 | GfAfuaGfgGfuGfaUfgUfuCfcGfaAfuUf | 3558 | uUfcGfgAfaCfaUfcAfcCfcUfAfucsUfsu | 4209 |
| D-3545 | gAfUfaGfgGfuGfaUfgUfuCfcGfaAfuUf | 3559 | uUfcGfgAfaCfaUfcAfcCfcUfauCfsUfsu | 4210 |
| D-3546 | gaUfaGfgGfuGfaUfgUfuCfcGfaAfuUf | 3560 | uUfcGfgAfaCfaUfcAfcCfcUfaUfCfsusu | 4211 |
| D-3547 | GfaUfaGfgGfuGfaUfguUfCfcGfaAfuUf | 3561 | uUfcGfgaAfCfaUfcAfcCfcUfaUfcsUfsu | 4212 |
| D-3548 | GfaUfaGfgGfuGfaUfgUfUfccGfaAfuUf | 3562 | uUfcGfGfaaCfaUfcAfcCfcUfaUfcsUfsu | 4213 |
| D-3549 | GfaUfaGfgGfuGfaUfgUfucCfGfaAfuUf | 3563 | uUfcgGfAfaCfaUfcAfcCfcUfaUfcsUfsu | 4214 |
| D-3550 | GfaUfaGfgGfuGfaUfgUfuCfCfgaAfuUf | 3564 | uUfCfggAfaCfaUfcAfcCfcUfaUfcsUfsu | 4215 |
| D-3551 | GfaUfaGfgGfuGfaUfgUfuCfcgAfAfuUf | 3565 | uuCfGfgAfaCfaUfcAfcCfcUfaUfcsUfsu | 4216 |
| D-3552 | GfaUfaGfgGfuGfaUfgUfuCfcGfAfauUf | 3566 | UfucGfgAfaCfaUfcAfcCfcUfaUfcsUfsu | 4217 |
| D-3553 | GfaUfaGfgGfuGfaUfgUfuCfcGfaaUfUf | 3567 | UfUfcGfgAfaCfaUfcAfcCfcUfaUfcsUfsu | 4218 |
| D-3554 | GfAfuaGfgGfguGfAfugUfUfccGfAfauUf | 3568 | UfucGfGfaaCfAfucAfCfccUfAfucsUfsUf | 4219 |
| D-3555 | gaUfAfggGfUfgaUfGfuuCfCfgaAfUfu | 3569 | uUfCfggAfAfcaUfCfacCfCfuaUfCfsusu | 4220 |
| D-3556 | GfauAfGfggUfGfauGfUfucCfgGfaaUfUf | 3570 | UfUfcgGfAfacAfUfcaCfCfcuAfUfcsusUf | 4221 |
| D-3557 | gAfUfagGfGfugAfUfguUfCfcgAfAfuu | 3571 | uuCfGfgaAfCfauCfAfccCfUfauCfsUfsu | 4222 |
| D-3558 | GcAGuuuGcAGGuuAucAudTsdT | 3572 | AUGAuAACCUGcAAACUGCdTsdT | 4223 |
| D-3559 | GfcAfgUfuUfGfCfAfgGfgUfuAfuCfaUfuUf | 3573 | aUfgAfuAfaCfcugcaAfaCfUfgCfcsUfsu | 4224 |
| D-3560 | GfcAfgUfuUfGfcAfgGfuUfuAfuCfaUfuUf | 3574 | aUfgAfuAfaCfcuGfcaAfaCfUfgCfcsUfsu | 4225 |
| D-3561 | GfcAfgUfuUfgcAfGfgUfuAfuCfaUfuUf | 3575 | aUfgAfuAfaCfcuGfCfaAfaCfUfgCfcsUfsu | 4226 |
| D-3562 | GfcAfgUfuUfgCfAfGfGfUfuAfuCfaUfuUf | 3576 | aUfgAfuAfaccugCfaAfaCfUfgCfcsUfsu | 4227 |
| D-3563 | GfcAfgUfuUfgCfAfggGfUfuAfuCfaUfuUf | 3577 | aUfgAfuAfaCfCfugCfaAfaCfUfgCfcsUfsu | 4228 |
| D-3564 | GfcAfgUfuUfgCfAfggUfuAfuCfaUfuUf | 3578 | aUfgAfuAfaCfCfugCfaAfaCfUfgCfcsUfsu | 4229 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3565 | GfcAfgUfuuGfCfaGfgUfuAfuCfaUfuUf | 3579 | aUfgAfuAfaCfcUfgcAfAfaCfuGfcsUfsu | 4230 |
| D-3566 | GfcAfgUfuUfgCfaGfGfuuAfuCfaUfuUf | 3580 | aUfgAfuAfAfccUfgCfaAfaCfuGfcsUfsu | 4231 |
| D-3567 | GfscsAfgUfuuGfCfaGfgUfuAfuCfaUfuUf | 3581 | asUfsgAfuAfaCfcUfgcAfAfaCfuGfcsUfsu | 4232 |
| D-3568 | GfcAfgUfuuGfCfaGfgUfuAfuCfaUfuUf | 3582 | aUfgAfuAfaCfcUfgcAfAfaCfuGfcUfu | 4233 |
| D-3569 | GfscsAfgUfuUfgCfaGfGfuuAfuCfaUfuUf | 3583 | asUfsgAfuAfAfccUfgCfaAfaCfuGfcsUfsu | 4234 |
| D-3570 | GfcAfgUfuUfgCfaGfGfuuAfuCfaUfuUf | 3584 | aUfgAfuAfAfccUfgCfaAfaCfuGfcUfu | 4235 |
| D-3571 | GfcAfgUfUfugCfaGfgUfuAfuCfaUfuUf | 3585 | aUfgAfuAfaCfcUfgCfAfaaCfuGfcsUfsu | 4236 |
| D-3572 | GfcAfguUfUfgCfaGfgUfuAfuCfaUfuUf | 3586 | aUfgAfuAfaCfcUfgCfaaAfCfuGfcsUfsu | 4237 |
| D-3573 | GfcAfGfuuUfgCfaGfgUfuAfuCfaUfuUf | 3587 | aUfgAfuAfaCfcUfgCfaAfAfcuGfcsUfsu | 4238 |
| D-3574 | GfcaGfUfuUfgCfaGfgUfuAfuCfaUfuUf | 3588 | aUfgAfuAfaCfcUfgCfaAfacUfGfcsUfsu | 4239 |
| D-3575 | GfCfagUfuUfgCfaGfgUfuAfuCfaUfuUf | 3589 | aUfgAfuAfaCfcUfgCfaAfaCfUfgcsUfsu | 4240 |
| D-3576 | gCfAfgUfuUfgCfaGfgUfuAfuCfaUfuUf | 3590 | aUfgAfuAfaCfcUfgCfaAfaCfugCfsUfsu | 4241 |
| D-3577 | gcAfgUfuUfgCfaGfgUfuAfuCfaUfuUf | 3591 | aUfgAfuAfaCfcUfgCfaAfaCfuGfCfsusu | 4242 |
| D-3578 | GfcAfgUfuUfgCfaGfguUfAfuCfaUfuUf | 3592 | aUfgAfuaAfCfcUfgCfaAfaCfuGfcsUfsu | 4243 |
| D-3579 | GfcAfgUfuUfgCfaGfgUfUfauCfaUfuUf | 3593 | aUfgAfUfaaCfcUfgCfaAfaCfuGfcsUfsu | 4244 |
| D-3580 | GfcAfgUfuUfgCfaGfgUfuaUfCfaUfuUf | 3594 | aUfgaUfAfaCfcUfgCfaAfaCfuGfcsUfsu | 4245 |
| D-3581 | GfcAfgUfuUfgCfaGfgUfuAfUfcaUfuUf | 3595 | aUfGfauAfaCfcUfgCfaAfaCfuGfcsUfsu | 4246 |
| D-3582 | GfcAfgUfuUfgCfaGfgUfuAfucAfUfuUf | 3596 | auGfAfuAfaCfcUfgCfaAfaCfuGfcsUfsu | 4247 |
| D-3583 | GfcAfgUfuUfgCfaGfgUfuAfuCfAfuuUf | 3597 | AfugAfuAfaCfcUfgCfaAfaCfuGfcsUfsu | 4248 |
| D-3584 | GfcAfgUfuUfgCfaGfgUfuAfuCfauUfuUf | 3598 | AfUfgAfuAfaCfcUfgCfaAfaCfuGfcsUfsu | 4249 |
| D-3585 | GfCfagUfUfugCfAfggUfUfauCfAfuuUf | 3599 | AfugAfUfaaCfCfugCfAfaaCfUfgcsUfsUf | 4250 |
| D-3586 | gcAfGfuuUfGfcaGfGfuuAfUfcaUfUfu | 3600 | aUfGfauAfAfccUfGfcaAfAfcuGfCfsusu | 4251 |
| D-3587 | GfcaGfUfuuGfCfagGfUfuaUfCfauUfUf | 3601 | AfUfgaUfAfacCfUfgcAfAfacUfGfcsusUf | 4252 |
| D-3588 | gCfAfguUfUfgcAfGfGfguUfAfucAfUfuu | 3602 | auGfAfuaAfCfcuGfCfaaAfCfugCfsUfsu | 4253 |
| D-3589 | GGuuGucuGuGuGAucGGAdTsdT | 3603 | UCCGAUcAcAcAGAcAACCdTsdT | 4254 |
| D-3590 | GfgUfuGfuCfUfGfUfGfuGfaUfcGfgAfuUf | 3604 | uCfcGfaUfcAfcacagAfcAfaCfcsUfsu | 4255 |
| D-3591 | GfgUfuGfuCfUfgUfGfuGfaUfcGfgAfuUf | 3605 | uCfcGfaUfcAfcaCfagAfcAfaCfcsUfsu | 4256 |
| D-3592 | GfgUfuGfuCfugUfGfuGfaUfcGfgAfuUf | 3606 | uCfcGfaUfcAfcaCfAfgAfcAfaCfcsUfsu | 4257 |
| D-3593 | GfgUfuGfuCfuGfUfGfUfGfaUfcGfgAfuUf | 3607 | uCfcGfaUfcacacAfgAfcAfaCfcsUfsu | 4258 |
| D-3594 | GfgUfuGfuCfuGfUfgUfGfaUfcGfgAfuUf | 3608 | uCfcGfaUfcaCfacAfgAfcAfaCfcsUfsu | 4259 |
| D-3595 | GfgUfuGfuCfuGfUfgUgGfaUfcGfgAfuUf | 3609 | uCfcGfaUfcAfCfacAfgAfcAfaCfcsUfsu | 4260 |
| D-3596 | GfgUfuGfuCfuGfuGfuGfaUfcGfgAfuUf | 3610 | uCfcGfaUfcAfcAfcaGfAfcAfaCfcsUfsu | 4261 |
| D-3597 | GfgUfuGfuCfuGfuGfUfgaUfcGfgAfuUf | 3611 | uCfcGfaUfCfacAfcAfgAfcAfaCfcsUfsu | 4262 |
| D-3598 | GfsgsUfgFucUfGfuGfuGfaUfcGfgAfuUf | 3612 | usCfscGfaUfcAfcAfcaGfAfcAfaCfcsUfsu | 4263 |
| D-3599 | GfgUfuGfucUfGfuGfuGfaUfcGfgAfuUf | 3613 | uCfcGfaUfcAfcAfcaGfAfcAfaCfcUfu | 4264 |
| D-3600 | GfsgsUfgFucFuGfuGfuGfgaUfcGfgAfuUf | 3614 | usCfscGfaUfCfacAfcAfgAfcAfaCfcsUfsu | 4265 |
| D-3601 | GfgUfuGfuCfuGfuGfuGfUfgaUfcGfgAfuUf | 3615 | uCfcGfaUfCfacAfcAfgAfcAfaCfcUfu | 4266 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3602 | GfgUfuGfUfcuGfuGfuGfaUfcGfgAfuUf | 3616 | uCfcGfaUfcAfcAfcAfGfacAfaCfcsUfsu | 4267 |
| D-3603 | GfgUfugUfCfuGfuGfuGfaUfcGfgAfuUf | 3617 | uCfcGfaUfcAfcAfcAfgaCfAfaCfcsUfsu | 4268 |
| D-3604 | GfgUfUfguCfuGfuGfuGfaUfcGfgAfuUf | 3618 | uCfcGfaUfcAfcAfcAfgAfCfaaCfcsUfsu | 4269 |
| D-3605 | GfguUfGfuCfuGfuGfuGfaUfcGfgAfuUf | 3619 | uCfcGfaUfcAfcAfcAfgAfcaAfCfcsUfsu | 4270 |
| D-3606 | GfGfuuGfuCfuGfuGfuGfaUfcGfgAfuUf | 3620 | uCfcGfaUfcAfcAfcAfgAfcAfAfccsUfsu | 4271 |
| D-3607 | gGfUfuGfuCfuGfuGfuGfaUfcGfgAfuUf | 3621 | uCfcGfaUfcAfcAfcAfgAfcAfacCfsUfsu | 4272 |
| D-3608 | ggUfuGfuCfuGfuGfuGfaUfcGfgAfuUf | 3622 | uCfcGfaUfcAfcAfcAfgAfcAfaCfCfsusu | 4273 |
| D-3609 | GfgUfuGfuCfuGfuGfugAfUfcGfgAfuUf | 3623 | uCfcGfauCfAfcAfcAfgAfcAfaCfcsUfsu | 4274 |
| D-3610 | GfgUfuGfuCfuGfuGfuGfAfucGfgAfuUf | 3624 | uCfcGfAfucAfcAfcAfgAfcAfaCfcsUfsu | 4275 |
| D-3611 | GfgUfuGfuCfuGfuGfuGfauCfGfgAfuUf | 3625 | uCfcgAfUfcAfcAfcAfgAfcAfaCfcsUfsu | 4276 |
| D-3612 | GfgUfuGfuCfuGfuGfuGfaUfCfggAfuUf | 3626 | uCfcgaUfcAfcAfcAfgAfcAfaCfcsUfsu | 4277 |
| D-3613 | GfgUfuGfuCfuGfuGfuGfaUfcgGfAfuUf | 3627 | ucCfgaUfcAfcAfcAfgAfcAfaCfcsUfsu | 4278 |
| D-3614 | GfgUfuGfuCfuGfuGfuGfaUfcGfGfauUf | 3628 | UfccGfaUfcAfcAfcAfgAfcAfaCfcsUfsu | 4279 |
| D-3615 | GfgUfuGfuCfuGfuGfuGfaUfcGfgaUfUf | 3629 | UfCfcGfaUfcAfcAfcAfgAfcAfaCfcsUfsu | 4280 |
| D-3616 | GfGfuuGfUfcuGfUfguGfAfucGfGfauUf | 3630 | UfccGfAfucAfcCfacAfGfacAfAfccsUfsUf | 4281 |
| D-3617 | ggUfUfguCfUfuguGfUfUfgaUfCfggAfUfu | 3631 | uCfcfgaUfCfacAfCfagAfCfaaCfCfsusu | 4282 |
| D-3618 | GfguUfGfucUfGfugUfGfauCfGfgaUfUf | 3632 | UfCfcgAfUfcaCfAfcaGfAfcaAfCfcsusUf | 4283 |
| D-3619 | gGfUfugUfCfugUfGfugAfUfcgGfAfuu | 3633 | ucCfgfauCfAfcaCfAfgaCfAfacCfsUfsu | 4284 |
| D-3620 | cGGAcuAcGAGAcGGGcuudTsdT | 3634 | AAGCCCGUCUCGuAGUCCGdTsdT | 4285 |
| D-3621 | CfgGfaCfuAfCfGfAfGfaCfgGfgCfUfuFuf | 3635 | aAfgCfcCfgUfcucguAfgUfcCfgsUfsu | 4286 |
| D-3622 | CfgGfaCfuAfCfgAfGfaCfgGfgCfuUfuUf | 3636 | aAfgCfcCfgUfcuCfguAfgUfcCfgsUfsu | 4287 |
| D-3623 | CfgGfaCfuAfcgAfGfaCfgGfgCfuUfuUf | 3637 | aAfgCfcCfgUfcuCfGfuAfgUfcCfgsUfsu | 4288 |
| D-3624 | CfgGfaCfuAfcGfAfGfAfCfgGfgCfuUfuUf | 3638 | aAfgCfcCfgucucGfuAfgUfcCfgsUfsu | 4289 |
| D-3625 | CfgGfaCfuAfcGfAfgAfCfgGfgCfuUfuUf | 3639 | aAfgCfcCfguCfucGfuAfgUfcCfgsUfsu | 4290 |
| D-3626 | CfgGfaCfuAfcGfAfgaCfgGfgCfuUfuUf | 3640 | aAfgCfcCfgUfCfucGfuAfgUfcCfgsUfsu | 4291 |
| D-3627 | CfgGfaCfuaCfgfaGfaCfgGfgCfuUfuUf | 3641 | aAfgCfcCfgUfcUfcgUfAfgUfcCfgsUfsu | 4292 |
| D-3628 | CfgGfaCfuAfcGfaGfAfcgGfgCfuUfuUf | 3642 | aAfgCfcCfGfucUfcGfuAfgUfcCfgsUfsu | 4293 |
| D-3629 | CfsgsGfaCfuaCfgfaGfaCfgGfgCfuUfuUf | 3643 | asAfsgCfcCfgUfcUfcgUfAfgUfcCfgsUfsu | 4294 |
| D-3630 | CfgGfaCfuaCfgfaGfaCfgGfgCfuUfuUf | 3644 | aAfgCfcCfgUfcUfcgUfAfgUfcCfgUfu | 4295 |
| D-3631 | CfsgsGfaCfuAfcGfaGfAfcgGfgCfuUfuUf | 3645 | asAfsgCfcCfGfucUfcGfuAfgUfcCfgsUfsu | 4296 |
| D-3632 | CfgGfaCfuAfcGfaGfAfcgGfgCfuUfuUf | 3646 | aAfgCfcCfGfucUfcGfuAfgUfcCfgUfu | 4297 |
| D-3633 | CfgGfaCfUfacGfaGfaCfgGfgCfuUfuUf | 3647 | aAfgCfcCfgUfcUfcGfUfagUfcCfgsUfsu | 4298 |
| D-3634 | CfgGfacUfAfcGfaGfaCfgGfgCfuUfuUf | 3648 | aAfgCfcCfgUfcUfcGfuaGfUfcCfgsUfsu | 4299 |
| D-3635 | CfgGfAfcuAfcGfaGfaCfgGfgCfuUfuUf | 3649 | aAfgCfcCfgUfcUfcGfuAfGfucCfgsUfsu | 4300 |
| D-3636 | CfggAfCfuAfcGfaGfaCfgGfgCfuUfuUf | 3650 | aAfgCfcCfgUfcUfcGfuAfguCfCfgsUfsu | 4301 |
| D-3637 | CfGfgaCfuAfcGfaGfaCfgGfgCfuUfuUf | 3651 | aAfgCfcCfgUfcUfcGfuAfgUfCfcgsUfsu | 4302 |
| D-3638 | cGfGfaCfuAfcGfaGfaCfgGfgCfuUfuUf | 3652 | aAfgCfcCfgUfcUfcGfuAfgUfcCfgsUfsu | 4303 |
| D-3639 | cgGfaCfuAfcGfaGfaCfgGfgCfuUfuUf | 3653 | aAfgCfcCfgUfcUfcGfuAfgUfcCfGfsusu | 4304 |

TABLE 6-continued

ASGR1 chemically modified siRNA Sequences

| Duplex No. | Sense Sequence (5'-3') | SEQ ID NO: (sense) | Antisense Sequence (5'-3') | SEQ ID NO: (antisense) |
|---|---|---|---|---|
| D-3640 | CfgGfaCfuAfcGfaGfacGfGfgCfuUfuUf | 3654 | aAfgCfccGfUfcUfcGfuAfgUfcCfgsUfsu | 4305 |
| D-3641 | CfgGfaCfuAfcGfaGfaCfGfggCfuUfuUf | 3655 | aAfgCfCfcgUfcUfcGfuAfgUfcCfgsUfsu | 4306 |
| D-3642 | CfgGfaCfuAfcGfaGfaCfggGfCfuUfuUf | 3656 | aAfgcCfCfgUfcUfcGfuAfgUfcCfgsUfsu | 4307 |
| D-3643 | CfgGfaCfuAfcGfaGfaCfgGfGfcuUfuUf | 3657 | aAfGfccCfgUfcUfcGfuAfgUfcCfgsUfsu | 4308 |
| D-3644 | CfgGfaCfuAfcGfaGfaCfgGfgcUfUfuUf | 3658 | aaGfCfcCfgUfcUfcGfuAfgUfcCfgsUfsu | 4309 |
| D-3645 | CfgGfaCfuAfcGfaGfaCfgGfgCfUfuuUf | 3659 | AfagCfcCfgUfcUfcGfuAfgUfcCfgsUfsu | 4310 |
| D-3646 | CfgGfaCfuAfcGfaGfaCfgGfgCfuuUfUf | 3660 | AfAfgCfcCfgUfcUfcGfuAfgUfcCfgsUfsu | 4311 |
| D-3647 | CfGfgaCfUfacGfAfgaCfGfggCfUfuuUf | 3661 | AfagCfCfcgUfCfucGfUfagUfCfcgsUfsUf | 4312 |
| D-3648 | cgGfAfcuAfCfgaGfAfcgGfGfcuUfUfu | 3662 | aAfGfccCfGfucUfCfguAfGfucCfGfsusu | 4313 |
| D-3649 | CfggAfCfuaCfGfagAfCfggGfCfuuUfUf | 3663 | AfAfgcCfCfguCfUfcgUfAfguCfCfgsusUf | 4314 |
| D-3650 | cGfGfacUfAfcgAfGfacGfGfgcUfUfuu | 3664 | aaGfCfccGfUfcuCfGfuaGfUfccGfsUfsu | 4315 |

Synthesis of chemically modified siRNA sequences was performed on the GE AKTA OligoPilot 100.

Materials:

Acetonitrile (DNA Synthesis Grade, AXO152-2505, EMD)

Capping Reagent A (20% N-methylimidazole in acetonitrile, BI0224-0505, EMD, Lot #56090)

Capping Reagent B1 (20% acetic anhydride in acetonitrile, BI0347-0505, EMD, Lot #55015)

Capping Reagent B2 (30% 2,6-lutidine in aceotnitrile, BI0349-0505, EMD, Lot #55176)

Capping Reagent B1 and B2 were mixed together 1:1 (v/v).

Activator (0.3 M benzylthiotetrazole (BTT) in acetonitrile, BI0166-1005, EMD Lot #55106, over molecular sieves)

Detritylation Reagent (3% dichloroacetic acid in toluene, BI0832-2505, EMD, Lot #55316)

Oxidation Reagent (0.05 M iodine in 90:10 pyridine/water, BI0424-1005, EMD, Lot #54323)

Diethylamine solution (20% DEA in acetonitrile, NC0017-0505, EMD, Lot #55202)

Ammonium hydroxide (concentrated, J. T. Baker)

Thiolation Reagent, 0.2 M phenylacetic disulfide (PADS, Aldrich) in 50:50 2-methylpyridine (picoline, Aldrich)/N-methylpyrrolidinone (NMP), Aldrich)

Thymidine (Thermo Fisher Scientific) and 2'-O-methyl and 2'-fluoro phosphoramidites of adenosine, guanosine, cytosine, and uridine (Thermo Fisher Scientific), 0.15 M in acetonitrile over ~10 mL of molecular sieves (J. T. Baker)

Primer Support 5G UnyLinker 350, Lot #10236161, 343 µmol/g, 0.60 g (206 µmol) or Primer Support 5G Amino with GalNAc cluster Synthesis:

Reagent solutions, phosphoramidite solutions, and solvents were attached to the instrument. Solid support was added to the column (6.3 mL), and the column was affixed to the instrument. The column was flushed with acetonitrile. The synthesis was started using the Unicorn software. The phosphoramidite and reagent solution lines were purged. The synthesis was accomplished by repetition of the deprotection/coupling/oxidation/capping synthesis cycle. To the solid support was added detritylation reagent to remove the 5'-dimethoxytrityl (DMT) protecting group. The solid support was washed with acetonitrile. To the support was added phosphoramidite and activator solution followed by recycling to couple the incoming nucleotide to the free 5'-hydroxyl group. The support was washed with acetonitrile. To the support was added oxidation or thiolation reagent to convert the phosphite triester to the phosphate triester or phosphorothioate. To the support was added capping reagents A and B to terminate any unreacted oligonucleotide chains. The support was washed with acetonitrile. After the final reaction cycle, the resin was washed with diethylamine solution to remove the 2-cyanoethyl protecting groups. The support was washed with acetonitrile.

Cleavage:

The synthesis column was removed from the synthesizer and dried under vacuum for 20 minutes. The column was opened, and the solid support was transferred to a 100 mL bottle. To the solid support was added 40 mL of concentrated ammonium hydroxide. The cap was tightly affixed to the bottle, and the mixture was heated at 65° C. overnight. The bottle was moved to the freezer and cooled for 20 minutes before opening in the hood. The mixture was filtered through a 60 mL M fitted glass funnel. The bottle and solid support were rinsed with 20 mL of 50:50 ethanol/water and then 40 mL of water.

Analysis and Purification:

A portion of the combined filtrate was analyzed and purified by anion exchange chromatography. The pooled fractions were desalted by size exclusion chromatography and analyzed by ion pair-reversed phase HPLC. The pooled fractions were lyophilized to obtain a white amorphous powder.

Analytical anion exchange chromatography (AEX):

Column: Thermo DNAPac PA200RS (4.6×50 mm, 4 µm)
Instrument: Agilent 1100 HPLC
Buffer A: 20 mM sodium phosphate, 10% acetonitrile, pH 8.5
Buffer B: 20 mM sodium phosphate, 10% acetonitrile, pH 8.5, 1 M sodium bromide Flow rate: 1 mL/min at 40° C.

Gradient: 20-65% B in 6.2 min

Preparative anion exchange chromatography (AEX):

Column: Tosoh TSK Gel SuperQ-SPW, 21×150 mm, 13 µm

Instrument: Agilent 1200 HPLC

Buffer A: 20 mM sodium phosphate, 10% acetonitrile, pH 8.5

Buffer B: 20 mM sodium phosphate, 10% acetonitrile, pH 8.5, 1 M sodium bromide

Flow rate: 8 mL/min

Injection volume: 5 mL

Gradient: 35-55% B over 20 min

Preparative Size Exclusion Chromatography (SEC):

Column: GE Hi-Prep 26/10

Instrument: GE AKTA Pure

Buffer: 20% ethanol in water

Flow Rate: 10 mL/min

Injection volume: 15 mL using sample loading pump

Ion Pair-Reversed Phase (IP-RP) HPLC:

Column: Water Xbridge BEH OST C18, 2.5 µm, 2.1×50 mm

Instrument: Agilent 1100 HPLC

Buffer A: 15.7 mM DIEA, 50 mM HFIP in water

Buffer B: 15.7 mM DIEA, 50 mM HFIP in 50:50 water/acetonitrile

Flow rate: 0.5 mL/min

Gradient: 10-30% B over 6 min

Annealing:

A small amount of the sense strand and the antisense strand were weighed into individual vials. To the vials was added siRNA reconstitution buffer (Qiagen) to an approximate concentration of 2 mM based on the dry weight. The actual sample concentration was measured on the NanoDrop One (ssDNA, extinction coefficient=33 µg/OD260). The two strands were then mixed in an equimolar ratio, and the sample was heated for 3 minutes in a 90° C. water bath and allowed to cool slowly to room temperature. The sample was analyzed by AEX. The RNA duplex was observed to have a longer retention time by analytical AEX than the single strands. The duplex was registered and submitted for in vitro (see methods described in Examples 2 and 3) and in vivo (see methods described in Example 6) testing.

Example 5

Synthesis of GalNAc-Containing Ligand

This example describes the synthesis of a tetravalent GalNAc moiety, which can be conjugated to the double-stranded RNA molecules in the RNAi constructs of the invention to facilitate delivery and uptake of the RNAi constructs by the liver (e.g. hepatocytes). The synthetic scheme is depicted in FIG. 5.

Resin-Bound Tetraantennary GalNAc

Step 1: (S)-4-(2-((((9H-fluoren-9-yl)methoxy)carbonyl)amino)-3-(trityloxy)propoxy)-4-oxobutanoic acid (1)

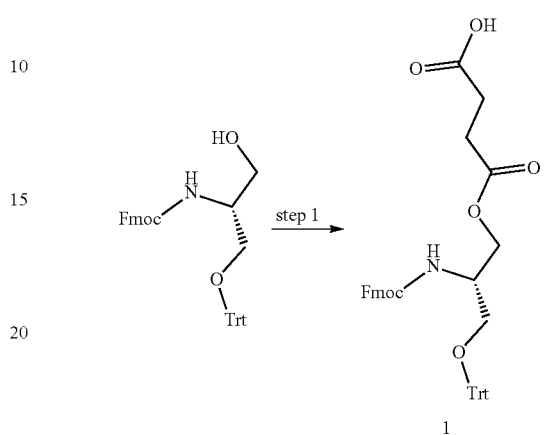

The (R)-(9H-fluoren-9-yl)methyl (1-hydroxy-3-(trityloxy)propan-2-yl)carbamate (20 g, 36.0 mmol), succinic anhydride (7.20 g, 72 mmol), polystyrene-supported DMAP (3 mmol/g, 24 g, 72 mmol) and triethylamine (10 mL, 72 mmol) were taken up in DCM (720 mL). The suspension was stirred at room temperature for 16 h. The reaction was filtered through Celite (to remove PS-dmap), and the filter cake was rinsed with DCM (200 mL). The combined filtrate was extracted with saturated aqueous NaCl (3×100 mL). The organic layer was dried over sodium sulfate and concentrated to afford the crude title compound (23.6 g, 36.0 mmol, 100% yield) which was used in the next step without further purification. MS m/z 678.2 (M+Na).

Step 2:

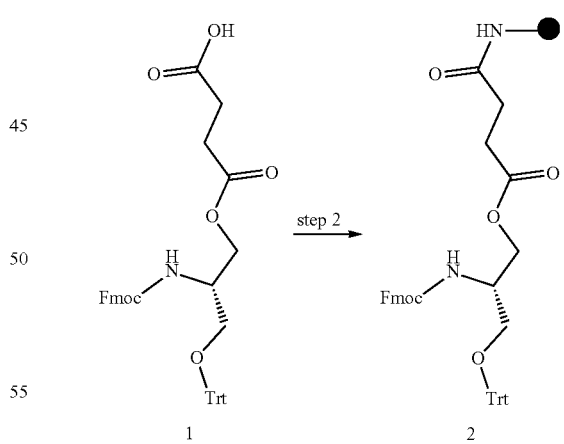

In a 50-mL conical tube, the activated hemisuccinate was prepared as follows: (S)-4-(2-((((9H-fluoren-9-yl)methoxy)carbonyl)amino)-3-(trityloxy)propoxy)-4-oxobutanoic acid (0.5 g, 0.763 mmol) and TATU (344 mg, 1.07 mmol) were dissolved in 5 mL of DMF, and the tube was swirled for 3 minutes. Hunig's base (0.400 mL, 2.29 mmol) was added. Meanwhile, the resin (Primer Support 5G Amino from GE Lifesciences, 0.46 mmol/g, 1.66 g, 0.763 mmol) was swelled in a 50-mL falcon tube in 10 mL of DMF. The activated hemisuccinate solution was added. The tube was gently shaken at room temperature at 400 rpm. The reaction mixture was filtered, then rinsed with DCM (50 mL), 10% MeOH-DCM (50 mL), then DCM (50 mL) and dried under vacuum. The resin was capped by adding a solution of acetic anhydride (5.625 mL, 59 mmol), pyridine (16.65 mL) and triethylamine (0.225 mL), and shaking at 400 rpm for 2 h at room temperature. The resin was filtered, rinsed with DCM (50 mL), 10% MeOH-DCM (50 mL), and DCM (50 mL) and dried under vacuum, to afford Intermediate 2 (2.55 g, 0.255 mmol/g, 0.65 mmol), which was used as is in the next step.

Step 3:

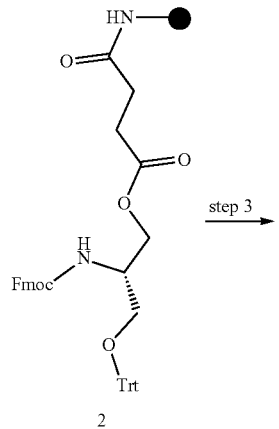

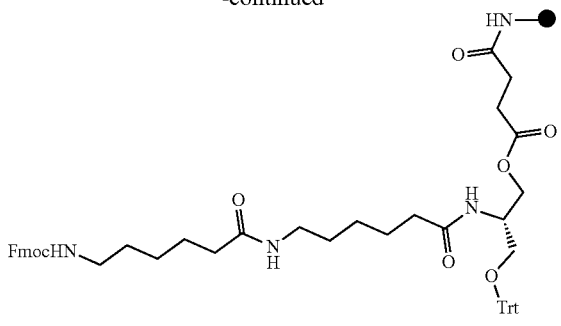

Intermediate 2 (2.55 g, 0.65 mmol) was suspended in a solution of 20% 4-methylpiperidine in DMF (15 mL) and stirred for 5 minutes. The solution was drained, and the process was repeated two more times to afford the deprotected intermediate. An activated solution of Fmoc-protected 6-aminohexanoic acid was made by dissolving Fmoc-protected 6-aminohexanoic acid (1.41 g, 4.0 mmol) and TATU (1.288 g, 4.0 mmol) in DMF (10 mL). After 5 minutes, Hunig's base (1.05 mL, 6.05 mmol) was added. This solution was added to the deprotected resin. The mixture was shaken at 400 rpm at room temperature overnight. The reaction was filtered, and the resin was washed with DMF (3×30 mL). The same procedure (deprotection, preparation of the activated acid, and coupling) was repeated to afford crude Intermediate 3 (2.40 g, 0.184 mmol/g, 0.442 mmol), which was used in the next step.

Step 4:

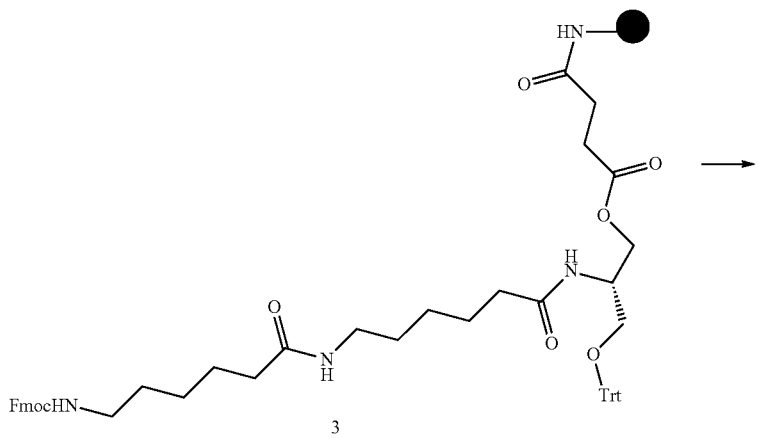

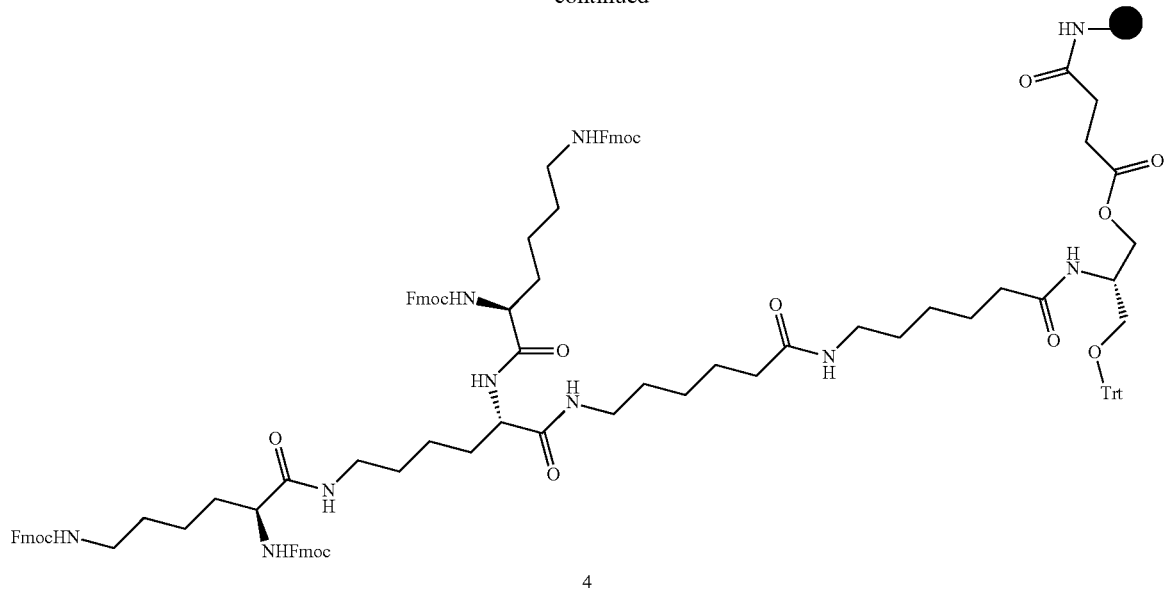

4

Intermediate 3 was suspended in a solution of 20% 4-methylpiperidine in DMF (15 mL) and stirred for 5 minutes. The solution was drained, and the process was repeated two more times to afford the deprotected intermediate. An activated solution of bis-Fmoc-protected lysine was prepared by dissolving bis-Fmoc-protected lysine (2.07 g, 3.5 mmol) and TATU (1.13 g, 3.5 mmol) in DMF (10 mL) and stirring for 5 minutes. Hunig's base (0.96 mL, 5.5 mmol) was added. This solution was added to the deprotected resin. The suspension was shaken at 400 rpm at room temperature overnight. The reaction mixture was filtered, and the resin was then washed with DMF (3×30 mL). The resin was deprotected using the procedure above. An activated solution of bis-Fmoc-protected lysine was prepared as above, except that the amount of bis-Fmoc-protected lysine was 2.96 g (5.0 mmol), the amount of TATU was 1.61 g (5.0 mmol), and the amount of Hunig's base was 1.31 mL (7.5 mmol), and the deprotected resin was coupled to the activated acid by shaking at 400 rpm at room temperature overnight. The resin was washed with DMF (3×30 mL) and then DCM (3×30 mL), and dried to afford crude Intermediate 4 (2.28 g, 0.165 mmol/g, 0.376 mmol).

Step 5:

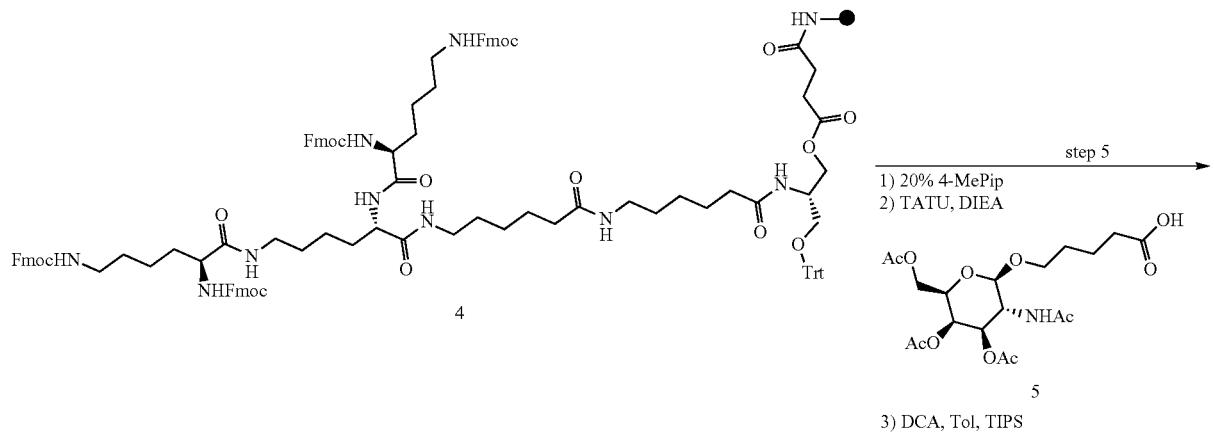

-continued

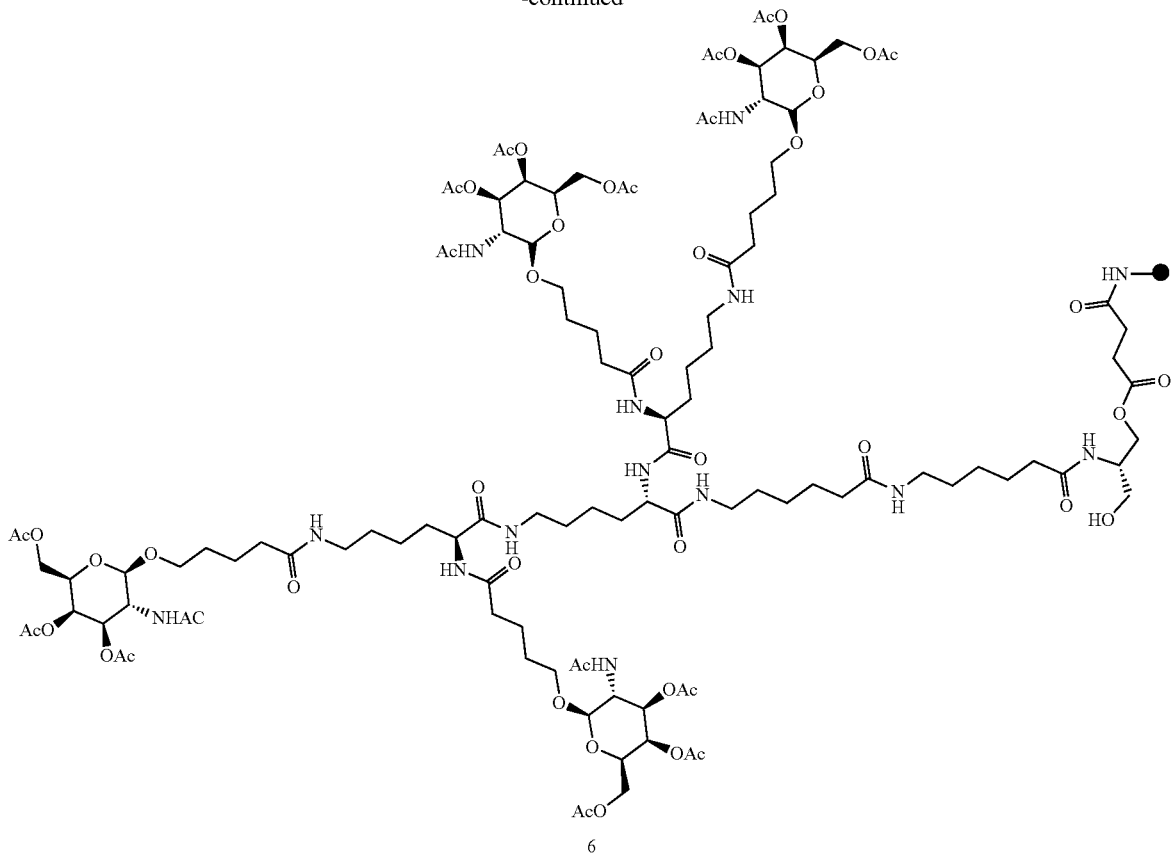

6

Intermediate 4 (0.4 mmol) was suspended in a solution of 20% 4-methylpiperidine in DMF (25 mL) and stirred for 5 minutes. The solution was drained, and the process was repeated one more time to afford the deprotected intermediate. To a solution of 5-(((2R,3R,4R,5R,6R)-3-acetamido-4,5-diacetoxy-6-(acetoxymethyl)tetrahydro-2H-pyran-2-yl)oxy)pentanoic acid (5, 2.68 g, 6 mmol) in DMF (20 mL) was added TATU (1.92 g, 6.0 mmol) and the solution was stirred for 5 min. Hunig's base (1.57 mL, 9.0 mmol) was added to the solution and the mixture was then added to the deprotected intermediate. The suspension was kept at room temperature overnight and the solvent was drained. The resin was washed with DMF (3×30 mL) and DCM (3×30 mL). The resin was treated with 3% Dichloroacetic acid in Tol with 5% TIPS (25 mL) and after 5 min the solvent was drained. The process was repeated two more times to give intermediate 6, which was used in the next step directly (e.g. conjugation reaction to 5' or 3' end of sense strand of an RNAi construct of the invention).

The chemically modified ASGR1 siRNAs alone or conjugated to the GalNAc moiety are evaluated for efficacy in reducing ASGR1 expression by the in vitro immunoassay described in Example 2, the RNA FISH assay described in Example 3, or the in vivo mouse model described in Example 6.

Example 6

In Vivo Efficacy of ASGR1 siRNA Molecules

To assess the efficacy of chemically modified ASGR1 siRNA molecules in reducing ASGR1 liver expression in vivo, the modified ASGR1 siRNA molecules (complexed with Invivofectamine® reagent) or GalNAc-siRNA conjugates are administered to C57BL/6J mice intravenously or subcutaneously. Specifically, mice are injected with buffer, indicated siRNA and matched control siRNA at 1-5 mg/kg body weight in 0.25 ml buffer on day 0. Animals are harvested for further analysis at day 2, day 4 and day 7. Liver total RNA from harvested animals is processed for qPCR analysis. The efficacy of the ASGR1 siRNA is assessed by comparing the amount of Asgr1 mRNA and ASGR1 protein in liver tissue of the siRNA-treated animals to the amount of Asgr1 mRNA and ASGR1 protein in liver tissue of animals injected with buffer or control siRNAs.

Serum levels of alkaline phosphatase and LDL cholesterol may also be measured in the mice at various times following injection with ASGR1 siRNA molecules or matched controls to assess the in vivo efficacy of ASGR1 siRNA molecules. Elevated serum alkaline phosphatase levels correlate with reduced serum levels of non-HDL cholesterol and reduced risk of coronary artery disease (Nioi et al., New England Journal of Medicine, Vol. 374(22):2131-2141, 2016, which is hereby incorporated by reference in its entirety). Thus, serum alkaline phosphatase levels can be used as a surrogate biomarker of efficacy of a particular ASGR1 siRNA to reduce serum non-HDL cholesterol levels or risk of coronary artery disease. Efficacious ASGR1 siRNA molecules are those that produce reduced serum non-HDL cholesterol (e.g. LDL cholesterol) levels or increased serum alkaline phosphatase levels in treated animals as compared to the levels in animals injected with buffer or control siRNAs.

Example 7

In Vitro Efficacy of ASGR1 Chemically Modified siRNA Molecules

Select chemically modified siRNA molecules listed in Table 6 were conjugated to the triantennary GalNAc moiety shown in Formula VII, the structure of which is reproduced below. The GalNAc moiety was conjugated to the 3' end of the sense strand of each duplex through a phosphodiester linkage.

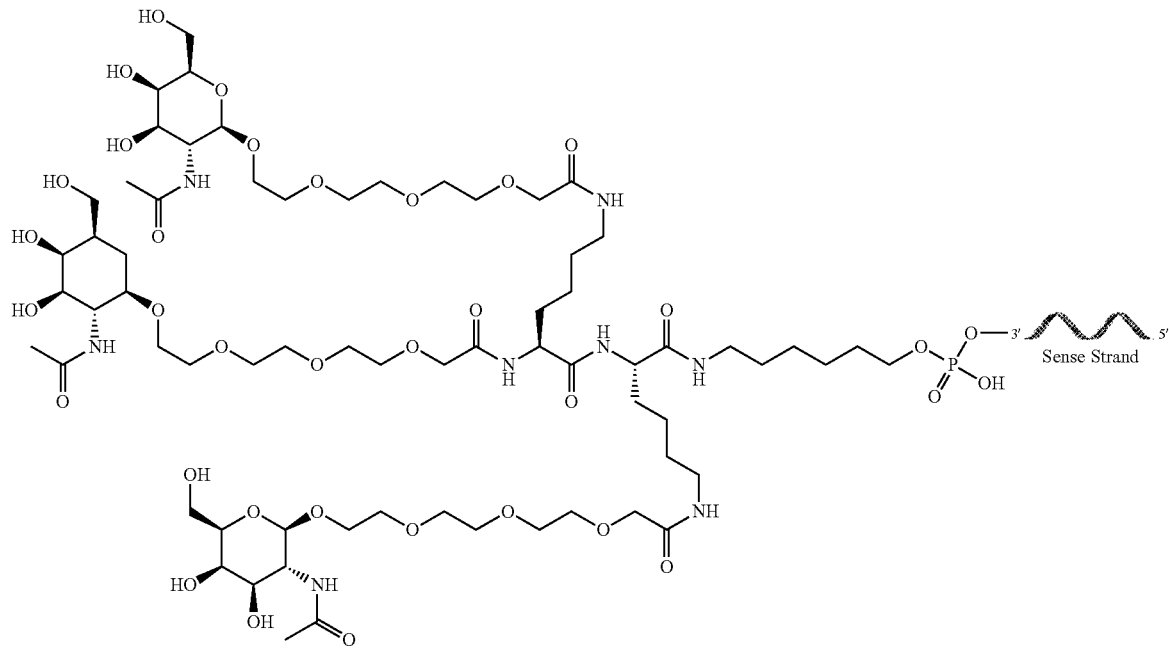 [SMILES: COP(=O)(O)OCCCCCCNC(=O)[C@H](CCCCNC(=O)COCCOCCOCCO[C@@H]1O[C@H](CO)[C@H](O)[C@H](O)[C@H]1NC(C)=O)NC(=O)[C@H](CCCCNC(=O)COCCOCCOCCO[C@@H]1O[C@H](CO)[C@H](O)[C@H](O)[C@H]1NC(C)=O)NC(=O)COCCOCCOCCO[C@@H]1C[C@H](CO)[C@H](O)[C@H](O)[C@H]1NC(C)=O]

The GalNAc-siRNA conjugates were evaluated for their ability to inhibit ASGR1 expression in the Hep3B cell transfection assay and human ASGR1 CHO cell free uptake assay. The Hep3B cell transfection immunoassay is described in Example 2 above. The free uptake assay utilizing Chinese Hamster Ovary (CHO) cells stably expressing human ASGR1 was conducted as follows. Gal-NAc-conjugated siRNA molecules in F-12K media (Corning Cellgro #10-025-CV) were prepared in 384-well plates. CHO cells stably expressing human ASGR1 in F-12K media supplemented with 10% fetal bovine serum and 1% antibiotic/antimycotic were added to each well. Cells were incubated for 4 days at 37° C. and 5% $CO_2$. Four days after siRNA delivery, cells were fixed in formaldehyde, blocked with bovine serum albumin, and subsequently stained with an anti-ASGR1 primary antibody (Amgen clone 7E11, light and heavy chain sequences provided in SEQ ID NOs: 3 and 4, respectively) for either 1 hour at room temperature or overnight at 4° C. Plates were washed three times with phosphate buffered saline (PBS). Cells were then incubated in the dark for 45 minutes at room temperature with Alexa488-conjugated anti-human IgG secondary antibody and nuclear stain Hoechst 33342 (Invitrogen #H3570) to assess cell number. Following three PBS washes, the plates were imaged on an Opera Phenix high-content screening system (PerkinElmer) using 488/500-550 and 375/435-480 excitation/emission filter settings to measure anti-ASGR1 antibody staining and nuclear staining, respectively. Data were analyzed using Columbus image analysis software and GeneData Screener software to quantify several measures of ASGR1 protein levels, cell count, and cell morphology on a per cell and per well basis.

The GalNAc-siRNA conjugates were tested at twenty-two different doses ranging from 0.000012 to 25 µM in each of the assays and dose-response curves were constructed. IC50 values and maximum antagonist activity values (relative to control cells; −1.0 max antagonist activity represents complete inhibition) were calculated from the dose-response curves. The results of the assays are shown in Table 7 below.

TABLE 7

In vitro efficacy of GalNAc-ASGR1 siRNA conjugates

| Duplex No. | Hep3B Transfected IC50 (µM) | Hep3B Transfected Max Antagonist Activity | hASGR1 CHO Free Uptake IC50 (µM) | hASGR1 CHO Free Uptake Max Antagonist Activity |
|---|---|---|---|---|
| D-3033 | 0.00325 | −0.84 | >0.5 | −0.34 |
| D-3034 | >0.167 | −0.46 | >0.5 | −0.08 |
| D-3036 | 0.00355 | −0.97 | >0.5 | −0.48 |
| D-3037 | 0.00395 | −0.96 | >0.5 | −0.55 |
| D-3044 | >0.5 | −0.05 | >0.5 | 0.13 |
| D-3046 | 0.00481 | −0.82 | >0.5 | −0.14 |
| D-3048 | 0.00288 | −0.93 | >0.5 | −0.31 |
| D-3050 | 0.00386 | −0.99 | >0.5 | −0.36 |
| D-3051 | 0.0124 | −0.82 | >0.5 | −0.51 |
| D-3053 | 0.00349 | −0.84 | >0.5 | −0.48 |
| D-3055 | 0.00346 | −0.82 | >0.5 | −0.26 |
| D-3057 | 0.0021 | −0.86 | >0.5 | −0.58 |
| D-3058 | >0.5 | 0.04 | >0.5 | 0.26 |
| D-3059 | 0.00966 | −0.82 | >0.5 | −0.12 |
| D-3060 | 0.00527 | −0.71 | >0.5 | −0.06 |
| D-3061 | >0.5 | 0.14 | >0.5 | −0.20 |
| D-3063 | 0.00541 | −1.0 | 0.395 | −0.20 |
| D-3071 | 0.00435 | −0.9 | >12.5 | −0.10 |
| D-3094 | 0.00544 | −0.9 | >25.0 | −0.40 |
| D-3102 | 0.00649 | −0.9 | >12.5 | −0.10 |
| D-3125 | 0.00144 | −0.9 | 0.694 | −0.40 |
| D-3133 | 0.00245 | −0.8 | >12.5 | −0.20 |
| D-3156 | 0.00206 | −0.5 | >25.0 | −0.10 |

TABLE 7-continued

In vitro efficacy of GalNAc-ASGR1 siRNA conjugates

| Duplex No. | Hep3B Transfected IC50 (μM) | Hep3B Transfected Max Antagonist Activity | hASGR1 CHO Free Uptake IC50 (μM) | hASGR1 CHO Free Uptake Max Antagonist Activity |
|---|---|---|---|---|
| D-3164 | 1.17 | −0.4 | 2.14 | −0.10 |
| D-3187 | 0.00653 | −0.6 | >25.0 | −0.10 |
| D-3195 | >0.0977 | −0.5 | 0.179 | −0.10 |
| D-3219 | >0.5 | 0.08 | >0.5 | −0.09 |
| D-3220 | >0.5 | 0.12 | >0.5 | −0.11 |
| D-3222 | 0.00406 | −0.95 | >0.5 | −0.14 |
| D-3223 | 0.00818 | −0.74 | >0.5 | −0.07 |
| D-3228 | 0.000479 | −0.9 | >25.0 | −0.20 |
| D-3230 | >12.5 | −0.2 | >25.0 | −0.10 |
| D-3231 | >12.5 | −0.2 | >25.0 | −0.20 |
| D-3232 | 0.30214 | −0.6 | >25.0 | −0.10 |
| D-3233 | 0.00468 | −0.4 | >25.0 | −0.10 |
| D-3234 | 1.5879 | −0.8 | >25.0 | 0.20 |
| D-3235 | 0.00109 | −0.9 | >25.0 | 0.10 |
| D-3236 | 0.0047 | −0.7 | >25.0 | −0.20 |
| D-3237 | 0.000178 | −0.9 | >25.0 | −0.20 |
| D-3238 | 0.00336 | −0.9 | >25.0 | −0.30 |
| D-3239 | 0.00394 | −0.9 | >25.0 | −0.20 |
| D-3240 | 0.00458 | −0.9 | >25.0 | −0.20 |
| D-3241 | >12.5 | −0.2 | >25.0 | −0.10 |
| D-3242 | >12.5 | −0.2 | >25.0 | 0.20 |
| D-3243 | 0.00122 | −0.9 | >25.0 | −0.10 |
| D-3244 | >12.5 | −0.1 | >25.0 | 0.10 |
| D-3245 | >12.5 | −0.4 | >25.0 | 0.10 |
| D-3246 | >12.5 | −0.2 | >25.0 | −0.20 |
| D-3247 | >12.5 | −0.2 | >25.0 | −0.10 |
| D-3249 | 0.0137 | −0.6 | >25.0 | 0.00 |
| D-3257 | 2.33 | −0.4 | >12.5 | −0.30 |
| D-3280 | 0.00407 | −1.0 | >25.0 | −0.10 |
| D-3288 | 0.011 | −0.7 | >12.5 | 0.10 |
| D-3311 | 0.0068 | −0.8 | >25.0 | −0.20 |
| D-3319 | >12.5 | −0.3 | >12.5 | 0.00 |
| D-3342 | 0.00217 | −0.9 | 0.703 | −0.30 |
| D-3350 | 0.00512 | −0.7 | >12.5 | −0.10 |
| D-3373 | 0.00961 | −0.6 | >25.0 | 0.00 |
| D-3381 | >12.5 | −0.2 | >12.5 | −0.20 |
| D-3404 | 0.00497 | −0.8 | >25.0 | −0.30 |
| D-3412 | 0.00915 | −0.6 | >12.5 | −0.10 |
| D-3435 | 0.00302 | −0.7 | >25.0 | 0.10 |
| D-3443 | >12.5 | −0.3 | >6.25 | −0.20 |
| D-3467 | 0.00473 | −0.7 | >25.0 | −0.20 |
| D-3468 | >12.5 | −0.2 | >25.0 | 0.20 |
| D-3470 | 0.079127 | −0.9 | >25.0 | −0.30 |
| D-3471 | 0.38449 | −0.9 | >25.0 | −0.10 |
| D-3474 | 0.648 | −0.4 | >25.0 | 0.00 |
| D-3476 | 0.23421 | −0.9 | >25.0 | −0.40 |
| D-3478 | >12.5 | −0.1 | >25.0 | 0.20 |
| D-3479 | 0.948 | −0.3 | >25.0 | −0.10 |
| D-3480 | 0.274 | −0.5 | >25.0 | 0.10 |
| D-3481 | 0.00181 | −0.8 | >25.0 | 0.00 |
| D-3482 | 0.54988 | −0.9 | >25.0 | −0.10 |
| D-3483 | 0.35517 | −0.9 | >25.0 | −0.20 |
| D-3484 | 1.3218 | −0.9 | >25.0 | −0.20 |
| D-3485 | 0.00376 | −0.9 | 1.71 | −0.30 |
| D-3486 | 0.0054 | −0.9 | >25.0 | −0.10 |
| D-3487 | 0.00419 | −0.8 | >25.0 | −0.20 |
| D-3488 | 0.00582 | −0.9 | >25.0 | −0.10 |
| D-3489 | 0.737 | −0.3 | >25.0 | 0.10 |
| D-3490 | >12.5 | 0.0 | >25.0 | −0.10 |
| D-3491 | 0.00799 | −0.8 | 2.53 | −0.30 |
| D-3505 | >12.5 | −0.3 | 11 | −0.30 |
| D-3528 | 0.000536 | −1.0 | >25.0 | −0.10 |
| D-3536 | 0.00559 | −0.8 | >12.5 | 0.10 |
| D-3559 | 0.00285 | −1.0 | >25.0 | 0.00 |
| D-3567 | 0.0027 | −1.0 | >25.0 | −0.20 |

Several of the GalNAc-siRNA conjugates knocked down ASGR1 expression by greater than 80% when transfected into Hep3B cells. In particular GalNAc-siRNA conjugates targeting nucleotides 692 to 710 of the human ASGR1 transcript variant 1 (NM_001671.4; SEQ ID NO: 1) having various chemical modification patterns (e.g. Duplex Nos. 3036, 3037, 3051, 3053, and 3057) exhibited low nanomolar IC50 values when transfected into Hep3B cells and about 50% maximum knockdown activity in the CHO cell free uptake assay. Changing the GalNAc moiety in the conjugates to other triantennary GalNAc structures described herein (e.g. Formula XVI) improved performance of the GalNAc-siRNA conjugates in the free uptake assay (data not shown).

Example 8

Design and Efficacy of Additional GalNAc-ASGR1 siRNA Molecules

Additional GalNAc-ASGR1 siRNA conjugates were made that had varying patterns of chemical modifications, different sequences, and different GalNAc moieties. Table 8 below lists the modifications in the sense and antisense sequences and the structure and site of conjugation for the GalNAc moiety for each of the GalNAc-ASGR1 siRNA conjugates. The nucleotide sequences in Table 8 are listed according to the following notations: A, U, G, and C=corresponding ribonucleotide; dT, dA, dG, dC=corresponding deoxyribonucleotide; a, u, g, and c=corresponding 2'-O-methyl ribonucleotide; Af, Uf, Gf, and Cf=corresponding 2'-deoxy-2'-fluoro ("2'-fluoro") ribonucleotide; Phos=terminal nucleotide has a monophosphate group at its 5' end; and invAb=inverted abasic nucleotide (i.e. abasic nucleotide linked to adjacent nucleotide via a substitutent at its 3' position (a 3'-3' linkage)). Insertion of an "s" in the sequence indicates that the two adjacent nucleotides are connected by a phosphorothiodiester group (e.g. a phosphorothioate internucleotide linkage). Unless indicated otherwise, all other nucleotides are connected by 3'-5' phosphodiester groups. GalNAc structures are shown in the referenced formulas, which are depicted above.

TABLE 8

GalNAc-ASGR1 siRNA Conjugates

| Duplex No. | GalNAc Moiety | Site of GalNAc Moiety Conjug. | Sense Sequence (5'-3') | SEQ ID NO: | Antisense Sequence (5'-3') | SEQ ID NO: |
|---|---|---|---|---|---|---|
| D-3651 | Formula VII | 3' end of sense strand | {Phos}GfsusGfgGfaAfGfAfAfdAgAfuGfaAfgUfuUf | 4319 | {Phos}asCfsuUfcAfuCfuuucuUfcCfcAfcsUfsu | 4513 |
| D-3652 | Formula VII | 3' end of sense strand | {Phos}GfsusGfgGfaAfGfdAAfAfgAfuGfaAfgUfuUf | 4320 | {Phos}asCfsuUfcAfuCfuuucuUfcCfcAfcsUfsu | 4513 |
| D-3653 | Formula VII | 3' end of sense strand | {Phos}GfsusGfgGfaAfgdAAfAFGfAfuGfaAfgUfuUf | 4321 | {Phos}asCfsuUfcAfucuuuCfuUfcCfcAfcsUfsu | 4514 |
| D-3654 | Formula VII | 3' end of sense strand | {Phos}GfsusGfgGfaAfgAfAfdAGfAfuGfaAfgUfuUf | 4322 | {Phos}asCfsuUfcAfucuuuCfuUfcCfcAfcsUfsu | 4514 |
| D-3655 | Formula VII | 3' end of sense strand | {Phos}GfsusGfgGfaaGfAfadAgAfaAfgAfuAfgUfuUf | 4323 | {Phos}asCfsuUfcAfuCfuUfucUfUfcCfcAfcsUfsu | 4515 |
| D-3656 | Formula VII | 3' end of sense strand | {Phos}GfsusGfgGfaaGfAfdAAfAfgAfuGfaAfgUfuUf | 4324 | {Phos}asCfsuUfcAfuCfuUfucUfUfcCfcAfcsUfsu | 4515 |
| D-3657 | Formula VII | 3' end of sense strand | {Phos}GfsusGfgGfaaGfdAaAfAfgAfuGfaAfgUfuUf | 4325 | {Phos}asCfsuUfcAfuCfuUfucUfUfcCfcAfcsUfsu | 4515 |
| D-3658 | Formula VII | 3' end of sense strand | {Phos}gsusgggaAfgAfadAgaugaaguuu | 4326 | {Phos}asCfsuUfcAfuCfuUfCfuUfCfcacsusu | 4516 |
| D-3659 | Formula VII | 3' end of sense strand | {Phos}GfsusGfgGfaAfGfAfAfgAfuGfaAfguuu | 4327 | {Phos}asCfsuUfcAfuCfuuucuUfcCfcAfcsUfsu | 4513 |

TABLE 8-continued

GalNAc-ASGR1 siRNA Conjugates

| Duplex No. | GalNAc Moiety Conjug. | Site of GalNAc Moiety Conjug. | Sense Sequence (5'-3') | SEQ ID NO: | Antisense Sequence (5'-3') | SEQ ID NO: |
|---|---|---|---|---|---|---|
| D-3660 | Formula VII | 3' end of sense strand | {Phos}GfscsAfgCfuGfcUfAfcCfuGfgUfcUfcCfuUf | 4328 | {Phos}gsAfsgAfaCfcAfgUfaGfcAfgCfuGfcsUfsu | 4517 |
| D-3661 | Formula VII | 3' end of sense strand | {Phos}GfscsAfgCfugCfUfAfCfuGfgUfucCfuCfuUf | 4329 | {Phos}gsAfsgAfacCfcAfguagCfAfgCfuGfcsUfsu | 4518 |
| D-3662 | Formula VII | 3' end of sense strand | {Phos}gsCfsaGfcUfgCfUfAfCfuGfgUfuCfuCfuUf | 4330 | {Phos}gsAfsgAfaCfcAfguagCfaGfcUfgCfsusUf | 4519 |
| D-3663 | Formula VII | 3' end of sense strand | {Phos}GfscsAfgCfuGfcUfAfCfUfggUfuCfuCfuUf | 4331 | {Phos}gsAfsgAfaCfcAfcaguaGfcAfgCfuGfcsUfsu | 4520 |
| D-3664 | Formula VII | 3' end of sense strand | {Phos}GfscsAfgCfuGfcUfAfCfUfggGfUfcUfcUfu | 4332 | {Phos}GfsaasGfaAfcCfcaguaGfcAfgCfuGfcsUfsu | 4521 |
| D-3665 | Formula VII | 3' end of sense strand | {Phos}GfscsAfgCfuGfCfUfAfdCuGfgUfuCfuCfuUf | 4333 | {Phos}gsAfsgAfaCfcAfguagcAfgCfuGfcsUfsu | 4522 |
| D-3666 | Formula VII | 3' end of sense strand | {Phos}GfscsAfgCfuGfcdTAfcCfUfgGfgufuCfuCfuUf | 4334 | {Phos}gsAfsgAfaCfcAfguagcAfgCfuGfcsUfsu | 4522 |
| D-3667 | Formula VII | 3' end of sense strand | {Phos}GfscsAfgCfuGfcdTAfcCfUfgGfgufuCfuCfuUf | 4335 | {Phos}gsAfsgAfaCfcAfguaGfcAfgCfuGfcsUfsu | 4523 |
| D-3668 | Formula VII | 3' end of sense strand | {Phos}GfscsAfgCfuGfcUfAfdCUfgGfgufuCfuCfuUf | 4336 | {Phos}gsAfsgAfaCfcaguaGfcAfgCfuGfcsUfsu | 4523 |

TABLE 8-continued

GalNAc-ASGR1 siRNA Conjugates

| Duplex No. | GalNAc Moiety | Site of GalNAc Moiety Conjug. | Sense Sequence (5'-3') | SEQ ID NO: | Antisense Sequence (5'-3') | SEQ ID NO: |
|---|---|---|---|---|---|---|
| D-3669 | Formula VII | 3' end of sense strand | {Phos}GfscsAfgCfugCfUfadCuGfgUfucfucfuUf | 4337 | {Phos}gsAfsgAfaCfcAfgCfAfgCfuGfcsUfsu | 4524 |
| D-3670 | Formula VII | 3' end of sense strand | {Phos}GfscsAfgCfugCfUfdACfuGfgUfuCfucfuUf | 4338 | {Phos}gsAfsgAfaCfcAfgUfagCfAfgCfuGfcsUfsu | 4524 |
| D-3671 | Formula VII | 3' end of sense strand | {Phos}GfscsAfgCfugCfdTaCfuGfgUfuCfucfuUf | 4339 | {Phos}gsAfsgAfaCfcAfgUfagCfAfgCfuGfcsUfsu | 4524 |
| D-3672 | Formula VII | 3' end of sense strand | {Phos}gscsagcugCfcUfadCuguuucucuu | 4340 | {Phos}gsAfsgAfaCfcAfgUfaGfcAfgCfugcsusu | 4525 |
| D-3673 | Formula VII | 3' end of sense strand | {Phos}GfscsAfgCfuGfcfuAfcfuGfguucuCfuu | 4341 | {Phos}gsAfsgAfaCfcAfguagcAfgCfuGfcsUfsu | 4522 |
| D-3674 | Formula VII | 3' end of sense strand | {Phos}UfsgsUfgGfgAfaGfaAfaGfaUfgAfaGfuUf | 4342 | {Phos}csUfsuCfaUfcUfUfUfCfcfaCfasUfsu | 4526 |
| D-3675 | Formula VII | 3' end of sense strand | {Phos}UfsgsUfgGfgaAfGfAfAfaGfaUfgAfaGfuUf | 4343 | {Phos}csUfsuCfaUfcUfuucuUfCfcCfaCfasUfsu | 4527 |
| D-3676 | Formula VII | 3' end of sense strand | {Phos}usgsugggAfaGfaAfaAfagaugaaguu | 4344 | {Phos}csUfsuCfaUfcUfuUfcfuCfcfacasusu | 4528 |
| D-3677 | Formula VII | 3' end of sense strand | {Phos}usgsugGfgAfAfAfGfAfAfaGfaugaaGfuu | 4345 | {Phos}csUfsuCfaUfcUfuucuuCfcCfaCfasUfsu | 4529 |

TABLE 8-continued

GalNAc-ASGR1 siRNA Conjugates

| Duplex No. | GalNAc Moiety Conjug. | Site of GalNAc Moiety Conjug. | Sense Sequence (5'-3') | SEQ ID NO: | Antisense Sequence (5'-3') | SEQ ID NO: |
|---|---|---|---|---|---|---|
| D-3678 | Formula VII | 3' end of sense strand | {Phos}GfuGfgGfaAfGfAfAfAfgAfuGfaAfgUfuUf | 4346 | {Phos}aCfuUfcAfuCfuuucuUfcCfcAfcUfu | 4530 |
| D-3679 | Formula VII | 3' end of sense strand | {Phos}GfcAfgCfuGfCfUfAfCfuGfgUfuCfucUfuUf | 4347 | {Phos}gAfgAfaCfcAfguagcAfgCfuGfcUfu | 4531 |
| D-3680 | Formula VII | 3' end of sense strand | {Phos}UfgUfgGfgAfAfGfAfAfaGfaUfgAfaGfuUf | 4348 | {Phos}cUfuCfaUfcUfuucuuCfcCfacCfaUfu | 4532 |
| D-3681 | Formula VII | 3' end of sense strand | {Phos}AfgGfaCfuGfUfGfCfCfcAfcUfuCfacCfuUf | 4349 | {Phos}gUfgAfaGfuGfggcacAfgUfcCfuUfu | 4533 |
| D-3682 | Formula VII | 3' end of sense strand | {Phos}GfaGfaCfgGfGfCfUfUfcAfaGfaAfcUfuUf | 4350 | {Phos}aGfuUfcUfuGfaagccCfgUfcUfcUfu | 4534 |
| D-3683 | Formula VII | 3' end of sense strand | {Phos}GfaGfcGfcAfGfCfUfGfCfUfacCfuGfgUfuUf | 4351 | {Phos}aCfcAfgGfuAfGfcagcuGfcGfcUfcUfu | 4535 |
| D-3684 | Formula VII | 3' end of sense strand | {Phos}GfuUfgUfcUfGfGfUfUfgAfuCfgGfaUfuUf | 4352 | {Phos}aUfcCfgAfuCfcacacaGfaCfaAfcUfu | 4536 |
| D-3685 | Formula VII | 3' end of sense strand | {Phos}GfgAfgCfuGfCfGfGfGfcGfcUfgAfgAfuUf | 4353 | {Phos}uCfucfagGfcCfcccgcAfgCfucUfcUfu | 4537 |
| D-3686 | Formula VII | 3' end of sense strand | {Phos}GfcCfgCfuGfGfAfAfcfcgAfcGfacCfgUfuUf | 4354 | {Phos}aCfgUfcGfuCfguuccAfgCfgGfcUfu | 4538 |

TABLE 8-continued

GalNAc-ASGR1 siRNA Conjugates

| Duplex No. | GalNAc Moiety | Site of GalNAc Moiety Conjug. | SEQ ID NO: | Sense Sequence (5'-3') | SEQ ID NO: | Antisense Sequence (5'-3') |
|---|---|---|---|---|---|---|
| D-3687 | Formula VII | 3' end of sense strand | 4355 | {Phos}GfcUfgGfgUfCfUfGfCfgAfgAfcAfgAfuUf | 4539 | {Phos}uCfuGfuCfuCfgcagaCfcCfaGfcUfu |
| D-3688 | Formula VII | 3' end of sense strand | 4356 | {Phos}GfcUfuUfcUfCfGfGfGfaAfuUfuUfcAfuUf | 4540 | {Phos}uGfaAfaAfaAfuUfcccgaGfaAfaGfcUfu |
| D-3689 | Formula VII | 3' end of sense strand | 4357 | {Phos}CfcUfccCfuGfCfUfGfCfuUfGfuGfGfuUf | 4541 | {Phos}aAfcCfaCfaAfgcagcAfgGfaGfgGfu |
| D-3690 | Formula VII | 3' end of sense strand | 4358 | {Phos}CfuAfuCfaCfaUfGfAfCfCfaAfgGfaGfuAfuUf | 4542 | {Phos}uAfUfcUfcCfUfuGfgucaUfgAfuAfgUfu |
| D-3691 | Formula VII | 3' end of sense strand | 4359 | {Phos}CfgUfccCfuuGfGfGfaAfgAfgCfaGfaAfuUf | 4543 | {Phos}uUfcUfgCfuCfcuccAfgGfaCfgUfu |
| D-3692 | Formula VII | 3' end of sense strand | 4360 | {Phos}CfuuGfGfgGffCfCfUfCfuuCfuUfgCfuUfuUf | 4544 | {Phos}aAfgCfaGfaAfgaggcCfcCfcAfgUfu |
| D-3693 | Formula VII | 3' end of sense strand | 4361 | {Phos}CfCfUfaUfcAfuUfgFafCfcAfaGfgAfgUfuUf | 4545 | {Phos}aCfuCfcUfuGfgcauGfaUfaGfgUfu |
| D-3694 | Formula VII | 3' end of sense strand | 4362 | {Phos}GfaUfaGfgUfuGfAfUfgUfuCfcGfaAfuUf | 4546 | {Phos}uUfcGfgAfaCfaucacCfcUfaUfcUfu |
| D-3695 | Formula VII | 3' end of sense strand | 4363 | {Phos}GfcAfgUfuUfGfCfAfgGfuGfUfuAfuCfaUfuUf | 4547 | {Phos}aUfgAfuAfaCfcugcaaAfaCfuGfcUfu |

TABLE 8-continued

GalNAc-ASGR1 siRNA Conjugates

| Duplex No. | GalNAc Moiety Conjug. | Site of GalNAc Moiety Conjug. | Sense Sequence (5'-3') | SEQ ID NO: | Antisense Sequence (5'-3') | SEQ ID NO: |
|---|---|---|---|---|---|---|
| D-3696 | Formula VII | 3' end of sense strand | {Phos}GfsusGfgGfaAfgAfAfAfgAfuGfaAfgUfcGf | 4364 | {Phos}csGfsaCfuUfcAfuCfuuuCfuUfcCfcAfcsUfsu | 4548 |
| D-3697 | Formula VII | 3' end of sense strand | {Phos}GfscsAfgCfuGfcUfAfCfuGfgUfuCfuCfucf | 4365 | {Phos}gsAfsgAfgAfaCfcAfguaGfcAfgCfuGfcsUfsu | 4549 |
| D-3698 | Formula VII | 3' end of sense strand | {Phos}UfsgsUfgGfgAfaGfAfAfaGfaAfgAfaGfucf | 4366 | {Phos}gsAfscUfucUfaUfcUfuucUfuCfcCfaCfasUfsu | 4550 |
| D-3699 | Formula VII | 3' end of sense strand | {Phos}AfsusGfuGfgfaAfGfAfAfAfgAfuGfaAfgUf | 4367 | {Phos}asCfsuUfcAfuCfuUfucuUfcCfcAfcAfusUfsu | 4551 |
| D-3700 | Formula VII | 3' end of sense strand | {Phos}GfscsGfcAfgCfuGfCfUfaCfuGfgUfuCfucf | 4368 | {Phos}gsAfsgAfacfcAfgUfagcAfgCfuGfcGfcsUfsu | 4552 |
| D-3701 | Formula VII | 3' end of sense strand | {Phos}AfsasUfgGfgAfaAfAfgAfaAfaGfaUfgAfaGf | 4369 | {Phos}csUfsuCfaUfcUfUfUfcuuCfcCfaCfaUfusUfsu | 4553 |
| D-3702 | Formula VII | 3' end of sense strand | {Phos}GfsasCfgGfgAfcCfgAfCfUfacCfgAfgAfuUf | 4370 | {Phos}usCfsuCfgUfaguccGfuCfcCfgUfcsUfsu | 4554 |
| D-3703 | Formula VII | 3' end of sense strand | {Phos}AfsgsCfcAfcCfuCfCfUfuAfuUfuU | 4371 | {Phos}asAfsuUfaAfaggagAfgGfuGfcfusUfsu | 4555 |
| D-3704 | Formula VII | 3' end of sense strand | {Phos}UfsgAfcCfuGfcGfAfGfcCfuGfafgCfuUf | 4372 | {Phos}gsCfsuCfagfguccCfaAfgGfuCfasUfsu | 4556 |

TABLE 8-continued

GalNAc-ASGR1 siRNA Conjugates

| Duplex No. | GalNAc Moiety Conjug. | Site of GalNAc Moiety Conjug. | Sense Sequence (5'-3') | SEQ ID NO: | Antisense Sequence (5'-3') | SEQ ID NO: |
|---|---|---|---|---|---|---|
| D-3705 | Formula VII | 3' end of sense strand | {Phos}CfscsUfgCfcUfuCfCfCfUfgGfcCfucCfuUf | 4373 | {Phos}gsAfsgGfcCfcaggaAfgAfgCfaGfgsUfsu | 4557 |
| D-3706 | Formula VII | 3' end of sense strand | {Phos}CfscsUfcCfuGfcUfCfUfCfcCfuGfgCfuUf | 4374 | {Phos}gsCfscCfaGfgaagGfcAfgGfaGfgsUfsu | 4558 |
| D-3707 | Formula VII | 3' end of sense strand | {Phos}GfscsUfgCfuAfcUfgGfgUfUfcUfcGfuUf | 4375 | {Phos}csGfsaGfaGfaaccaGfuAfgCfaGfcsUfsu | 4559 |
| D-3708 | Formula VII | 3' end of sense strand | {Phos}CfscsCfaUfcUfcCfAfAfgCfUfcCfaGfuUf | 4376 | {Phos}csUfsgAfaGfcuuggAfgAfaUfgGfgsUfsu | 4560 |
| D-3709 | Formula VII | 3' end of sense strand | {Phos}AfscsUfgGfuUfcUfCfUfCfcCfgGfuUf | 4377 | {Phos}csCfsgGfaGfcgagaGfaAfccCfaGfusUfsu | 4561 |
| D-3710 | Formula VII | 3' end of sense strand | {Phos}GfsaasCfgGfgAfcCfgGfgAfcUfacCfgAfgAfuUf | 4378 | {Phos}usCfsuCfgUfaGfuccguCfcCfgUfcsUfsu | 4562 |
| D-3711 | Formula VII | 3' end of sense strand | {Phos}AfsgsCfcAfcCfUfCfUfCfcUfuUfaAfuUfuUf | 4379 | {Phos}asAfsuUfaAfaGfgagagGfuUfgCfusUfsu | 4563 |
| D-3712 | Formula VII | 3' end of sense strand | {Phos}GfscsAfcGfaGfCfGfcAfgCfuGfcCfaCfuUf | 4380 | {Phos}gsUfsaGfcAfgCfugcgcUfcGfuGfcsUfsu | 4564 |
| D-3713 | Formula VII | 3' end of sense strand | {Phos}GfsasGfcAfgCfUfGfcUfacCfuGfGfuCfuUf | 4381 | {Phos}gsAfsaCfcAfgUfagcagCfuGfcGfcsUfsu | 4565 |

TABLE 8-continued

GalNAc-ASGR1 siRNA Conjugates

| Duplex No. | GalNAc Moiety Conjug. | Site of GalNAc Moiety Conjug. | Sense Sequence (5'-3') | SEQ ID NO: | Antisense Sequence (5'-3') | SEQ ID NO: |
|---|---|---|---|---|---|---|
| D-3714 | Formula VII | 3' end of sense strand | {Phos}AfscsGfgGfaCfGfGfAfCfuAfcGfaGfaCfuUf | 4382 | {Phos}gsUfscUfcGfuAfguccgUfcCfcGfusUfsu | 4566 |
| D-3715 | Formula VII | 3' end of sense strand | {Phos}GfscsUfcCfaCfGfUfGfAfaGfcAfgUfcCfuUf | 4383 | {Phos}gsAfsaCfgUfcUfucacgUfgGfaGfcsUfsu | 4567 |
| D-3716 | Formula VII | 3' end of sense strand | {Phos}UfsgsAfcCfuGfCfGfAfgCfcUfgAfgCfuUf | 4384 | {Phos}gsCfsuCfagCfgCfuccgcAfgGfuCfasUfsu | 4568 |
| D-3717 | Formula VII | 3' end of sense strand | {Phos}GfscsUfgCfgGfGfCfCfCfuGfaGfaGftUf | 4385 | {Phos}csUfsCfUfcAfggcccCfgCfaGfcsUfsu | 4569 |
| D-3718 | Formula VII | 3' end of sense strand | {Phos}UfsusCfaCfgGfAfCfGfAfcCfgCfcGfcUfuUf | 4386 | {Phos}asGfscGfgCfcGfucgucGfgUfgAfasUfsu | 4570 |
| D-3719 | Formula VII | 3' end of sense strand | {Phos}CfscsAfcGfaCfCfAfAfAfaCfgGfgCfcCfuUf | 4387 | {Phos}gsGfsgCfcCfgUfuuugGftcGfuGfgsUfsu | 4571 |
| D-3720 | Formula VII | 3' end of sense strand | {Phos}CfscsUfgCfuCfuCfCfCfuGfgGfcCftcUfuUf | 4388 | {Phos}gsAfsgGfcCfcAfgggagAfgCfaGfgsUfsu | 4572 |
| D-3721 | Formula VII | 3' end of sense strand | {Phos}CfscsUfcCfuGfCfUfCfUfcCfcCfuGfgCfuUf | 4389 | {Phos}gsCfscCfagGfgagagcAfgGfaGfgsUfsu | 4573 |
| D-3722 | Formula VII | 3' end of sense strand | {Phos}GfsgsGfaAfgAfAfAfAfGfaFfuGfaAfgUfcGfuUf | 4390 | {Phos}csGfsaCfUfcAfucuuuCfuUfcCfcsUfsu | 4574 |

TABLE 8-continued

GalNAc-ASGR1 siRNA Conjugates

| Duplex No. | GalNAc Moiety | Site of GalNAc Moiety Conjug. | Sense Sequence (5'-3') | SEQ ID NO: | Antisense Sequence (5'-3') | SEQ ID NO: |
|---|---|---|---|---|---|---|
| D-3723 | Formula VII | 3' end of sense strand | {Phos}CfscsAfcUfuCfAfCfCfGfaCfgAfcGfgCfuUf | 4391 | {Phos}gsCfscGfuCfgUfcGfgugAfaGfuGfgsUfsu | 4575 |
| D-3724 | Formula VII | 3' end of sense strand | {Phos}GfscsUfgCfuAfcUfUfGfGfuUfcUfcUfcGfuUf | 4392 | {Phos}csGfsaGfaGfaAfccaguAfgCfaGfcsUfsu | 4576 |
| D-3725 | Formula VII | 3' end of sense strand | {Phos}AfsasCfgGfgCfCfCfUfUfgGfaAfuGfgGfuUf | 4393 | {Phos}csCfscAfcUfuCfcagggCfcCfgUfusUfsu | 4577 |
| D-3726 | Formula VII | 3' end of sense strand | {Phos}AfsgsCfaGfcCfGfGfAfCfgAfcUfgAfcGfuAfuUf | 4394 | {Phos}usAfscCfagfuCfguccgGfcUfgCfusUfsu | 4578 |
| D-3727 | Formula VII | 3' end of sense strand | {Phos}CfsusGfcGfaGfAfCfAfGfaGfcUfgGfaCfuUf | 4395 | {Phos}gsUfscCfagfcUfcugucUfcGfcAfgsUfsu | 4579 |
| D-3728 | Formula VII | 3' end of sense strand | {Phos}GfsgsAfgGfaCfGfCfGfCfacCfcUfgGfuGfuUf | 4396 | {Phos}csAfscCfaGfgUfgcgcGfuCfcUfcsUfsu | 4580 |
| D-3729 | Formula VII | 3' end of sense strand | {Phos}UfscsAfcGfuCfCfUfGfgAfgGfaGfcAfuUf | 4397 | {Phos}usGfscUfcCfuCfccagaAfcGfuGfasUfsu | 4581 |
| D-3730 | Formula VII | 3' end of sense strand | {Phos}AfsasGfAfccCfUfGfCfUfgCfcCfgGfuCfuUf | 4398 | {Phos}gsAfscCfgGfgCfagcagGfuCfcUfusUfsu | 4582 |
| D-3731 | Formula VII | 3' end of sense strand | {Phos}CfscsCfaUfUfCfCfCfAfaGfcUfucfagGfuUf | 4399 | {Phos}csUfsgAfaGfcUfuggagAfaUfgGfgsUfsu | 4583 |

TABLE 8-continued

GalNAc-ASGR1 siRNA Conjugates

| Duplex No. | GalNAc Moiety Conjug. | Site of GalNAc Moiety Conjug. | Sense Sequence (5'-3') | SEQ ID NO: | Antisense Sequence (5'-3') | SEQ ID NO: |
|---|---|---|---|---|---|---|
| D-3732 | Formula VII | 3' end of sense strand | {Phos}AfsusGfgGfcCfUfCfCfAfcGfacCfcAfaAfuUf | 4400 | {Phos}usUfsuGfgUfcGfuggagGfcCfcAfusUfsu | 4584 |
| D-3733 | Formula VII | 3' end of sense strand | {Phos}CfsgsAfcGfgCfCfCfGfCfUfgGfaAfcGfaCfuUf | 4401 | {Phos}gsUfscGfuUfcCfagcggCfcGfuCfgsUfsu | 4585 |
| D-3734 | Formula VII | 3' end of sense strand | {Phos}AfscsUfgGfuUfCfUfCfUfcGfcUfcCfgGfuUf | 4402 | {Phos}csCfsgGfaGfcGfagagaAfcCfaGfusUfsu | 4586 |
| D-3735 | Formula VII | 3' end of sense strand | {Phos}CfsgsAfccfaaAfaAfaCfGfgGfccCfcUfgGfuUf | 4403 | {Phos}csCfsaaGfgCfCfcguuuUfgGfcCfgsUfsu | 4587 |
| D-3736 | Formula VII | 3' end of sense strand | {Phos}GfsgsUfcUfgCfGfaAfGfaCfaGfAfcgCfuGfuUf | 4404 | {Phos}csAfsgCfuCfuGfucucgCfaGfaCfcsUfsu | 4588 |
| D-3737 | Formula VII | 3' end of sense strand | {Phos}GfaCfggCfGfaCfCfGfGfAfcCfUfacCfgAfgAfuUf | 4405 | {Phos}uCfuCfgUfaGfuccguCfcCfgUfcUfu | 4589 |
| D-3738 | Formula VII | 3' end of sense strand | {Phos}AfgCfcAfcCfUfCfUfCfcUfuUfaAfuUfUfUf | 4406 | {Phos}aAfuUfaAfaGfgagagGfuGfgCfuUfu | 4590 |
| D-3739 | Formula VII | 3' end of sense strand | {Phos}UfgAfcCfuGfCfGfGfAfgcCfcUfgAfgcfuUf | 4407 | {Phos}gCfucfaGfcfuccgcAfgGfucfaUfu | 4591 |
| D-3740 | Formula VII | 3' end of sense strand | {Phos}CfcUfgCfucCfcCfcfuGfgGfccfucfuUf | 4408 | {Phos}gAfgGfcCfcAfggagAfgCfaGfgUfu | 4592 |

TABLE 8-continued

GalNAc-ASGR1 siRNA Conjugates

| Duplex No. | GalNAc Moiety Conjug. | Site of GalNAc Moiety Conjug. | Sense Sequence (5'-3') | SEQ ID NO: | Antisense Sequence (5'-3') | SEQ ID NO: |
|---|---|---|---|---|---|---|
| D-3741 | Formula VII | 3' end of sense strand | {Phos}CfcUfccfugCfcUfcCfcUfgGfgCfuUf | 4409 | {Phos}gCfcCfaGfgGfagagcAfgGfaGfgUfu | 4593 |
| D-3742 | Formula VII | 3' end of sense strand | {Phos}GfcUfgCfuAfCfuGfgGfuUfcUfcUfcGfuUf | 4410 | {Phos}cGfaGfaGfaAfccaguAfgCfaGfcUfu | 4594 |
| D-3743 | Formula VII | 3' end of sense strand | {Phos}CfcCfaUfucUfcUfcCfAfaGfcUfuCfaGfuUf | 4411 | {Phos}cUfgAfaGfcUfuggagAfaUfgGfgUfu | 4595 |
| D-3744 | Formula VII | 3' end of sense strand | {Phos}AfcUfgGfuUfcUfcUfcGfcUfcCfgGfuUf | 4412 | {Phos}cCfgGfaGfcGfagagaAfcCfaGfuUfu | 4596 |
| D-3745 | Formula XVI, k = 3, n = 1 | 5' end of sense strand | GfcAfgCfuGfcUfAfCfuFfggUfuCfucCfsusUf | 4413 | {Phos}gsAfsgAfaCfCfaguaGfcAfgGfcUfgCfcsUfsu | 4520 |
| D-3746 | Formula VIII | 3' end of sense strand | {Phos}GfsusGfgGfaAfgAfaFfAfAfGfauGfaAfgUfuUf | 4414 | {Phos}asCfsuUfcAfUfcuuuCfuUfcCfAfcsUfsu | 4597 |
| D-3747 | Formula VIII | 3' end of sense strand | {Phos}GfsusGfgGfaAfgAfaFfAfAfGfAfuGfaAfgUfuUf | 4415 | {Phos}asCfsuUfcAfucuuuCfuUfcCfAfcsUfsu | 4514 |
| D-3748 | Formula XVI, k = 3, n = 1 | 5' end of sense strand | GfuGfgGfaAfgAfaFfAfAfGfAfuGfaAfgUfsusUf | 4416 | {Phos}asCfsuUfcAfucuuuCfuUfcCfAfcsUfsu | 4514 |
| D-3749 | Formula VIII | 3' end of sense strand | {Phos}GfuGfgGfaaGfaAfaAfGfaUfgAfaGfaAfgUfuUf | 4417 | {Phos}aCfuUfcAfucfuUfucUfUfcCfcAfcUfu | 4598 |

TABLE 8-continued

GalNAc-ASGR1 siRNA Conjugates

| Duplex No. | GalNAc Moiety Conjug. | Site of GalNAc Moiety Conjug. | Sense Sequence (5'-3') | SEQ ID NO: | Antisense Sequence (5'-3') | SEQ ID NO: |
|---|---|---|---|---|---|---|
| D-3750 | Formula XVI, k = 3, n = 1 | 5' end of sense strand | GfuGfgGfaaGfAfaAfgAfuGfaAfgUfsusUf | 4418 | {Phos}asCfsuUfcAfuCfuUfucUfUfcCfcAfcsUfsu | 4515 |
| D-3751 | Formula XVI, k = 3, n = 1 | 5' end of sense strand | GfuGfgGfaAfgAfaAfgAfauGfaAfgUfsusUf | 4419 | {Phos}asCfsuUfcAfUfcUfuUfuCfuUfcCfcAfcsUfsu | 4599 |
| D-3752 | Formula XXVI | 5' end of sense strand | GfuGfgGfaAfgAfAfaAfgAfuGfaAfgUfsusUf | 4420 | {Phos}asCfsuUfcAfuCfuuuCfuUfccCfcAfcsUfsu | 4600 |
| D-3753 | None | N/A | {Phos}GfuGfgGfaAfgAfAfaAfAfAfGfAfuGfaAfgUfuUf | 4421 | {Phos}aCfuUfcAfucuuuCfuUfcCfcAfcUfu | 4601 |
| D-3754 | None | N/A | {Phos}GfuGfgGfaAfgGfaAfgAfaAfaAfgAfuGfaAfguUf | 4422 | {Phos}AfCfuUfcAfuCfuUfuCfuUfcCfcAfcUfu | 4602 |
| D-3755 | None | N/A | {Phos}GfuGfgGfgGfaAfgGfaAfgAfAfgAfauGfaAfgUfuUf | 4423 | {Phos}aCfuUfcAfUfcAfUfcuuuCfuUfcCfcAfcUfu | 4603 |
| D-3756 | None | N/A | {Phos}GfsusUfgGfgGfaAfgGfaAfgAfaAfgAfauGfsusUf | 4424 | {Phos}asCfsuUfcAfUfcuuuCfuUfcCfcAfcsUfsu | 4597 |
| D-3757 | None | N/A | {Phos}GfuGfgGfaAfgGfaAfgAfaAfgAfUfgAfaGfuUfu | 4425 | {Phos}AfCfuUfcAfUfcuuuCfuUfcCfcAfcUfu | 4604 |
| D-3758 | Formula VIII | 3' end of sense strand | {Phos}GfscsAfgCfuAfCfUfgCfgUfuCfuCfuUf | 4426 | {Phos}gsAfsgAfaCfcaguaGfcAfgCfuGfcsUfsu | 4523 |
| D-3759 | Formula VIII | 3' end of sense strand | {Phos}UfsgsUfgGfAfaGfAfAfAfGfaUfGfaAfgGfuUf | 4427 | {Phos}csUfsuCfAfUfcuuucUfUfcCfcTaCfasUfsu | 4605 |
| D-3760 | Formula VIII | 3' end of sense strand | {Phos}GfsusUfgGfgaaGfAfaAfgAfaAfgAfuGfaAfgUfuUf | 4428 | {Phos}asCfsuUfcAfuCfuuuucUfUfcCfcAfcsUfsu | 4515 |
| D-3761 | Formula VIII | 3' end of sense strand | {Phos}GfscsAfgCfugCfUfaCfuGfcgUfuCfucUfuUf | 4429 | {Phos}gsAfsgAfacCfcAfgUfagCfAfgCfuGfcsUfsu | 4524 |

TABLE 8-continued

GalNAc-ASGR1 siRNA Conjugates

| Duplex No. | GalNAc Moiety Conjug. | Site of GalNAc Moiety Conjug. | Sense Sequence (5'-3') | SEQ ID NO: | Antisense Sequence (5'-3') | SEQ ID NO: |
|---|---|---|---|---|---|---|
| D-3762 | Formula VIII | 3' end of sense strand | {Phos}GfsusGfgGfaAfgGfaAfaAfgAfaAfgUfuUf | 4430 | {Phos}asCfsuUfcAfuCfuUfuCfuUfcCfcAfcsUfsUf | 4606 |
| D-3763 | Formula VIII | 3' end of sense strand | {Phos}GfsusGfgGfaAfgGfaAfaAfgGfauGfaAfgUfuUf | 4431 | {Phos}asCfsuUfcAfuCfcuUfuCfuUfcCfcAfcsUfsu | 4599 |
| D-3764 | Formula VIII | 3' end of sense strand | {Phos}GfsusGfggAfAfgGfaAfaAfgGfaAfgUfuUf | 4432 | {Phos}asCfsuUfcAfuCfuUfuCfuuCfcfcAfcsUfsu | 4607 |
| D-3765 | Formula VIII | 3' end of sense strand | {Phos}GfsusgGfGfaAfgGfaAfaAfgGfaAfgUfuUf | 4433 | {Phos}asCfsuUfcAfuCfuUfuCfuUfccCfAfcsUfsu | 4608 |
| D-3766 | Formula VIII | 3' end of sense strand | {Phos}gsUfsGfgGfaAfgGfaAfaAfgGfaAfgUfuUf | 4434 | {Phos}asCfsuUfcAfuCfuUfuCfuUfcCfcacCfsUfsUf | 4609 |
| D-3767 | Formula XVI, k = 3, n = 1 | 5' end of sense strand | GfuGfgGfaAfgAfaAfaGfaAfUfgaAfgAfgUfsusUf | 4435 | {Phos}asCfsuUfcAfauCfuUfuCfuUfcCfcAfcsUfsu | 4610 |
| D-3768 | Formula XVI, k = 3, n = 1 | 5' end of sense strand | GfuGfgGfaAfgAfaAfaGfaAfgUfuAfaAfgUfsusUf | 4436 | {Phos}asCfsUfuCfAfuCfuUfuCfuUfcCfcAfcsUfsu | 4611 |
| D-3769 | Formula XVI, k = 3, n = 1 | 5' end of sense strand | GfuGfgGfaAfgAfaAfaGfaAfgUfuAfgUfsUfsusUf | 4437 | {Phos}AfscscsuUfcAfuCfuUfuCfuUfcCfcAfcsUfsu | 4612 |
| D-3770 | Formula XVI, k = 3, n = 1 | 5' end of sense strand | gUfgGfgGfaAfgAfaAfaGfaAfgAfuGfaAfgUfsusUf | 4438 | {Phos}asCfsuUfcAfuCfuucCfuUfcCfcAfcsUfsusUf | 4613 |

TABLE 8-continued

GalNAc-ASGR1 siRNA Conjugates

| Duplex No. | GalNAc Moiety Conjug. | Site of GalNAc Moiety Conjug. | Sense Sequence (5'-3') | SEQ ID NO: | Antisense Sequence (5'-3') | SEQ ID NO: |
|---|---|---|---|---|---|---|
| D-3771 | Formula XVI, k = 3, n = 1 | 5' end of sense strand | GfuGfgGfaAfgAfAfAfGfauGfaAfgUfsusUf | 4439 | {Phos}asCfsuUfcAfUfcuuuCfuUfcCfcAfcsUfsu | 4597 |
| D-3772 | Formula XVI, k = 3, n = 1 | 5' end of sense strand | GfuGfgGfaAfgAfAfAfGfafUfgAfaGfusUfsu | 4440 | {Phos}AfscsUfuCfaUfcuuuCfuUfcCfcAfcsUfsu | 4614 |
| D-3773 | Formula XVI, k = 3, n = 1 | 5' end of sense strand | GfcAfgCfuGfcUfAfcCfUfGfgUfuCfuCfsusUf | 4441 | {Phos}gsAfsgAfaCfcaguaGfcAfgCfuGfcsUfsu | 4523 |
| D-3774 | Formula XXIX | 3' end of sense strand | {Phos}GfsusGfgGfaAfgAfAfAfGfauGfaAfgUfuUf | 4414 | {Phos}asCfsuUfcAfUfcuuuCfuUfcCfcAfcsUfsu | 4597 |
| D-3775 | Formula XXIX | 3' end of sense strand | {Phos}GfsusGfgGfaAfgAfAfAfGfauGfaAfgUfuUf | 4431 | {Phos}asCfsuUfcAfUfcuUfcUfcCfcAfcsUfsu | 4599 |
| D-3776 | None | N/A | {Phos}GfscsAfgCfuGfcUfacCfuGfgUfuCfuCfuUf | 4429 | {Phos}gsAfsgAfaCfcAfgUfagCfAfgCfuGfcsUfsUf | 4615 |
| D-3777 | None | N/A | {Phos}GfscsAfgCfuGfcUfAfcCfUfGfguUfuCfuCfuUf | 4426 | {Phos}gsAfsgAfaCfcaguaGfcAfgCfuGfcsUfsUf | 4616 |
| D-3778 | Formula VIII | 3' end of sense strand | {Phos}GfsusGfgGfaAfgAfAfAfGfauGfaAfgUfuUf | 4442 | {Phos}gsAfsgAfaccfAfgUfaGfcAfgCfuGfcsUfsu | 4617 |
| D-3779 | Formula XVI, k = 3, n = 1 | 5' end of sense strand | GfcCfgCfuGfaFfAfCfGfacGfacCfgUfsusUf | 4443 | {Phos}asCfsgUfcGfUfcguuCfcAfgCfgGfcsUfsu | 4618 |
| D-3780 | Formula XVI, k = 3, n = 1 | 5' end of sense strand | GfaUfaGfgGfuUfGfuUfcfcGfaAfsusUf | 4444 | {Phos}usUfscGfaAfAfcaucAfcCfcUfaUfcsUfsu | 4619 |

TABLE 8-continued

GalNAc-ASGR1 siRNA Conjugates

| Duplex No. | GalNAc Moiety Conjug. | Site of GalNAc Moiety Conjug. | Sense Sequence (5'-3') | SEQ ID NO: | Antisense Sequence (5'-3') | SEQ ID NO: |
|---|---|---|---|---|---|---|
| D-3781 | Formula XVI, k = 3, n = 1 | 5' end of sense strand | CfcUfaUfcAfuGfaFcFcfaaGfgAfgAfgUfsusUf | 4445 | {Phos}asCfsuCfCfUfggucAfuGfaUfaGfgsUfsu | 4620 |
| D-3782 | Formula XVI, k = 3, n = 1 | 5' end of sense strand | CfuAfufcUfaUfgAfcCfcFfAfagGfaGfuAfsusUf | 4446 | {Phos}usAfscUfcCfUfugguCfaUfgAfuAfgsUfsu | 4621 |
| D-3783 | Formula XVI, k = 3, n = 1 | 5' end of sense strand | AfaCfgCfgCfcCfUfGfGfaaGfuGfgGfsusUf | 4447 | {Phos}csCfscAfcUfUfccagGfgCfcCfgUfusUfsu | 4622 |
| D-3784 | Formula XVI, k = 3, n = 1 | 5' end of sense strand | GfaCfgGfgAfcGfgAfCfCfuaCfgAfgAfsusUf | 4448 | {Phos}usCfsuCfgUfAfguccGfuCfcCfgUfcsUfsu | 4623 |
| D-3785 | Formula XVI, k = 3, n = 1 | 5' end of sense strand | AfcGfgGfaCfgGfAfcCfUfacCfaGfaCfsusUf | 4449 | {Phos}gsUfscUfcGfUfaguccCfgUfccGfusUfsu | 4624 |
| D-3786 | Formula XVI, k = 3, n = 1 | 5' end of sense strand | AfgCfaGfcCfgAfcCfGfacUfgGfuAfsusUf | 4450 | {Phos}usAfscCfaGfUfcgucCfgGfcUfgCfusUfsu | 4625 |
| D-3787 | Formula XVI, k = 3, n = 1 | 5' end of sense strand | CfcAfcUfuCfacCfCfGfAfcGfAfcGfCfsusUf | 4451 | {Phos}gsCfscGfuCfGfucggUfgAfaGfaGfgsUfsu | 4626 |
| D-3788 | Formula XVI, k = 3, n = 1 | 5' end of sense strand | CfgAfcGfcCfgCfUfGfgaAfcGfaCfsusUf | 4452 | {Phos}gsUfscGfuUfCfcagcGfgCfcGfuCfgsUfsu | 4627 |
| D-3789 | Formula XVI, k = 3, n = 1 | 5' end of sense strand | AfaAfcCfcGfuGfCfGfcuUfcUfgGfsusUf | 4453 | {Phos}csAfsgAfaAfGfgcccAfcGfgUfuUfsu | 4628 |

TABLE 8-continued

GalNAc-ASGR1 siRNA Conjugates

| Duplex No. | GalNAc Moiety Conjug. | Site of GalNAc Moiety Conjug. | Sense Sequence (5'-3') | SEQ ID NO: | Antisense Sequence (5'-3') | SEQ ID NO: |
|---|---|---|---|---|---|---|
| D-3790 | Formula XVI, k = 3, n = 1 | 5' end of sense strand | CfcUfcUfcUfuGfcUfUfufucUfcGfgGfsusUf | 4454 | {Phos}csCfscGfaGfAfaagcAfgAfaGfaGfgsUfsu | 4629 |
| D-3791 | Formula XVI, k = 3, n = 1 | 5' end of sense strand | GfaAfaCfcCfgUfGfGfcCfgcUfuUfcUfsusUf | 4455 | {Phos}asGfsaAfAfGfCfgccaCfgGfgUfuUfcsUfsu | 4630 |
| D-3792 | Formula XVI, k = 3, n = 1 | 5' end of sense strand | GfcAfgAfaAfuUfuGfUfccAfgCfaCfsusUf | 4456 | {Phos}gsUfsgCfuGfGfacaaAfuUfuCfuGfcsUfsu | 4631 |
| D-3793 | Formula XVI, k = 3, n = 1 | 5' end of sense strand | GfgAfcUfacCfgAfGfAfCfggGfcUfuCfsusUf | 4457 | {Phos}gsAfsaGfcCfCfgucuCfgUfaGfuCfcsUfsu | 4632 |
| D-3794 | Formula XVI, k = 3, n = 1 | 5' end of sense strand | GfuGfcCfcAfcUfUfCfAfccGfaCfgAfsusUf | 4458 | {Phos}usCfsgUfcGfGfugaaGfuGfgGfcAfcsUfsu | 4633 |
| D-3795 | Formula XVI, k = 3, n = 1 | 5' end of sense strand | GfuUfgUfcUfgUfGfUfGfauCfgGfaUfsusUf | 4459 | {Phos}asUfscCfgAfUfcacaCfaGfaCfaAfcsUfsu | 4634 |
| D-3796 | Formula XVI, k = 3, n = 1 | 5' end of sense strand | GfgUfcUfgCfgAfGfAfCfagAfgCftuGfsusUf | 4460 | {Phos}csAfsgCfucUfUfgucuCfgCfaGfaCfcsUfsu | 4635 |
| D-3797 | Formula XVI, k = 3, n = 1 | 5' end of sense strand | AfgCfcAfccUfcUfCfCfuuUfaAftuUfsusUf | 4461 | {Phos}asAfsuUfaAfAfggagAfgGfuGfgCfusUfsu | 4636 |
| D-3798 | Formula XVI, k = 3, n = 1 | 5' end of sense strand | GfcUfccAfcCfgUfGfAfAfgcAfgUfuCfsusUf | 4462 | {Phos}gsAfsaCfuGfCfuucaCfgUfgGfaGfcsUfsu | 4637 |

TABLE 8-continued

GalNAc-ASGR1 siRNA Conjugates

| Duplex No. | GalNAc Moiety Conjug. | Site of GalNAc Moiety Conjug. | Sense Sequence (5'-3') | SEQ ID NO: | Antisense Sequence (5'-3') | SEQ ID NO: |
|---|---|---|---|---|---|---|
| D-3799 | Formula XVI, k = 3, n = 1 | 5' end of sense strand | GfcGfcAfgCfuGfcCfUfAfcuGfgUfuCfsusUf | 4638 | {Phos}gsAfsaCfcAfGfuagcAfgCfuGfcGfcsUfsu | 4463 |
| D-3800 | Formula XVI, k = 3, n = 1 | 5' end of sense strand | GfcUfgCfuAfcUfGfgUfuCfUfcCfgUfsusUf | 4639 | {Phos}csGfsaGfaGfAfaccaGfuAfgCfaGfcsUfsu | 4464 |
| D-3801 | Formula XVI, k = 3, n = 1 | 5' end of sense strand | AfcUfgGfuUfcUfCfUfCfgcCfUfcCfgGfsusUf | 4640 | {Phos}csCfsgGfaCfCfgagaGfaAfcCfaGfusUfsu | 4465 |
| D-3802 | Formula VIII | 3' end of sense strand | {Phos}GfcAfgCfuGfcUfAfCfUfGfgUfuCfuCfuUf | 4641 | {Phos}gAfgAfaCfcaguaGfcAfgCfuGfcUfu | 4466 |
| D-3803 | Formula VIII | 3' end of sense strand | GfcsAfgCfuGfcUfAfCfUfGfgUfuCfuCfuUf | 4642 | gsAfsgAfaCfcaguaGfcAfgCfuGfcsUfsu | 4467 |
| D-3804 | Formula XVI, k = 3, n = 1 | 5' end of sense strand | GfcAfGfCfUfGfcUfAfcUfGfgUfuCfuCfuUf | 4643 | {Phos}GAfGAfaCfcAGUAGfcAfGCfUGfcUfu | 4468 |
| D-3805 | Formula VIII | 3' end of sense strand | {Phos}gsUfsgGfgAfaGfAfaAfgAfuGfaAfgUfuUf | 4644 | {Phos}asCfsuUfcAfuCfuUfucUfuCfcCfaCfsusUf | 4469 |
| D-3806 | Formula XVI, k = 3, n = 1 | 5' end of sense strand | gUfgGfaGfAfaGfAfaAfgAfuGfaAfgUfsusUf | 4644 | {Phos}asCfsuUfcAfuCfuUfucUfuCfcCfacfsusUf | 4470 |
| D-3807 | Formula XVI, k = 3, n = 1 | 5' end of sense strand | gUfgGfaGfagAfaAfgAfuGfaAfgUfsusUf | 4645 | {Phos}asCfsuUfcAfuCfuUfuCfUfuCfcCfaCfsusUf | 4471 |

TABLE 8-continued

GalNAc-ASGR1 siRNA Conjugates

| Duplex No. | GalNAc Moiety Conjug. | Site of GalNAc Moiety Conjug. | Sense Sequence (5'-3') | SEQ ID NO: | Antisense Sequence (5'-3') | SEQ ID NO: |
|---|---|---|---|---|---|---|
| D-3808 | Formula XVI, k = 3, n = 1 | 5' end of sense strand | AfuGfgGfcCfcUfcCfAfCfgaCfcAfaAfsusUf | 4472 | {Phos}usUfsuGfgUfCfguggAfgGfcCfcAfusUfsu | 4646 |
| D-3809 | Formula XVI, k = 3, n = 1 | 5' end of sense strand | GfcAfcGfaGfcGfCfAfGfcuGfcUfaCfsusUf | 4473 | {Phos}gsUfsaGfcAfGfcugcGfcUfcGfuGfcsUfsu | 4647 |
| D-3810 | Formula XVI, k = 3, n = 1 | 5' end of sense strand | UfuCfaCfcGfaCfGfAfCfggCfcGfcUfsusUf | 4474 | {Phos}asGfscGfcCfgucgUfcGfgUfgAfasUfsu | 4648 |
| D-3811 | Formula XVI, k = 3, n = 1 | 5' end of sense strand | GfaAfgUfgGfgUfGfGfAfcgGfgAfcGfsusUf | 4475 | {Phos}csGfsuCfcCfguccaCfcCfaCfuUfcsUfsu | 4649 |
| D-3812 | Formula XVI, k = 3, n = 1 | 5' end of sense strand | UfcAfcGfuCfcUfGfGfGfagGfaGfcAfsusUf | 4476 | {Phos}usGfscUfcCfUfcccaGfaFfcGfuGfasUfsu | 4650 |
| D-3813 | Formula XVI, k = 3, n = 1 | 5' end of sense strand | GfuGfgGfaAfgAfAfAfAfGfauGfaAfgUfuUfs{invAb} | 4477 | {Phos}asCfsuUfcAfUfcuuuCfuUfcCfcAfcsUfsu | 4597 |
| D-3814 | Formula XVI, k = 3, n = 1 | 5' end of sense strand | [invAb]GfuGfgGfaAfgAfAfAfAfGfauGfaAfgUfuUfs{invAb} | 4478 | {Phos}asCfsuUfcAfUfcuuuCfuUfcCfcAfcsUfsu | 4597 |
| D-3815 | Formula XVI, k = 3, n = 1 | 5' end of sense strand | [invAb]GfuGfgGfaAfgAfAfAfAfGfauGfaAfgUfuUfs{invAb} | 4479 | {Phos}asCfsuUfcAfUfcuuuCfuUfcCfcAfcsUfsu | 4597 |
| D-3816 | Formula XVI, k = 3, n = 1 | 5' end of sense strand | GfuGfgGfaAfgAfAfAfAfGfauGfaAfgUfsusUf | 4439 | {Phos}asCfsuUfcAfUfcuuuCfuUfcCfcAfcUfus{invAb} | 4651 |

TABLE 8-continued

GalNAc-ASGR1 siRNA Conjugates

| Duplex No. | GalNAc Moiety Conjug. | Site of GalNAc Moiety Conjug. | Sense Sequence (5'-3') | SEQ ID NO: | Antisense Sequence (5'-3') | SEQ ID NO: |
|---|---|---|---|---|---|---|
| D-3817 | Formula XVI, k = 3, n = 1 | 5' end of sense strand | GfsusGfgGfaAfgAfAfAfGfauGfaAfgUfsusUf | 4480 | {Phos}asCfsuUfcAfUfcuuuCfuUfcCfcAfcsUfsu | 4597 |
| D-3818 | Formula XVI, k = 3, n = 1 | 5' end of sense strand | GfsusGfsgGfaAfgAfAfAfGfauGfaAfgUfsusUf | 4481 | {Phos}asCfsuUfcAfUfcuuuCfuUfcCfcAfcsUfsu | 4597 |
| D-3819 | Formula XVI, k = 3, n = 1 | 5' end of sense strand | GfuGfgGfaAfgAfAfAfGfauGfaAfgsUfsusUf | 4482 | {Phos}asCfsuUfcAfUfcuuuCfuUfcCfcAfcsUfsu | 4597 |
| D-3820 | Formula XVI, k = 3, n = 1 | 5' end of sense strand | GfuGfgGfaAfgAfAfAfGfauGfaAfgUfsusUf | 4483 | {Phos}asCfsuUfcAfUfcuuuCfuUfcCfcAfcsUfsu | 4597 |
| D-3821 | Formula XVI, k = 3, n = 1 | 5' end of sense strand | GfuGfgGfaAfgAfAfAfGfauGfaAfgUfsusUf | 4439 | {Phos}asCfsusUfcAfUfcuuuCfuUfcCfcAfcsUfsu | 4652 |
| D-3822 | Formula XVI, k = 3, n = 1 | 5' end of sense strand | GfuGfgGfaAfgAfAfAfGfauGfaAfgUfsusUf | 4439 | {Phos}asCfsuUfcAfUfcuuuCfuUfcCfcAfcsUfsu | 4653 |
| D-3823 | Formula XVI, k = 3, n = 1 | 5' end of sense strand | GfuGfgGfaAfgAfAfAfGfauGfaAfgUfsusUf | 4439 | {Phos}asCfsuUfcAfUfcuuuCfuUfcCfcAfsscsUfsu | 4654 |
| D-3824 | Formula XVI, k = 3, n = 1 | 5' end of sense strand | GfuGfgGfaAfgAfAfAfGfauGfaAfgUfsusUf | 4439 | {Phos}asCfsuUfcAfUfcuuuCfuUfcCfcAfcfcsUfsu | 4655 |
| D-3825 | Formula XVI, k = 3, n = 1 | 5' end of sense strand | GfuGfgGfaAfgAfAfAfGfauGfaAfgUfuUf | 4484 | {Phos}asCfsuUfcAfUfcuuuCfuUfcCfcAfcsUfsu | 4597 |

TABLE 8-continued

GalNAc-ASGR1 siRNA Conjugates

| Duplex No. | GalNAc Moiety | Site of GalNAc Moiety Conjug. | Sense Sequence (5'-3') | SEQ ID NO: | Antisense Sequence (5'-3') | SEQ ID NO: |
|---|---|---|---|---|---|---|
| D-3826 | Formula XVI, k = 3, n = 1 | 5' end of sense strand | GfuGfgGfaAfgAfAfAfGfauGfaAfgUfsusUf | 4439 | {Phos}aCfuUfcAfUfcuuuCfuUfcCfcAfcsUfsu | 4656 |
| D-3827 | Formula XVI, k = 3, n = 1 | 5' end of sense strand | GfuGfgGfaAfgAfAfAfGfauGfaAfgUfsusUf | 4439 | {Phos}asCfsuUfcAfUfcuuuCfuUfcCfcAfcUfu | 4657 |
| D-3828 | Formula XVI, k = 3, n = 1 | 5' end of sense strand | CfcGfcUfgGfaAfCfGfAfcgAfcGfuCfsusUf | 4485 | {Phos}gsAfscGfuCfgfucguUfcCfaGfcGfgsUfsu | 4658 |
| D-3829 | Formula XVI, k = 3, n = 1 | 5' end of sense strand | GfaUfgCfcAfcGfUfUfUfggCfgCfgUfsusUf | 4486 | {Phos}gsCfsaCfgCfCfaaacGfuGfgCfaUfcsUfsu | 4659 |
| D-3830 | Formula XVI, k = 3, n = 1 | 5' end of sense strand | GfaGfcAfcCfcAfGfGfGfagGfcAfaUfsusUf | 4487 | {Phos}asUfsuGfcCfUfcccuGfgGfuGfcUfcsUfsu | 4660 |
| D-3831 | Formula XVI, k = 3, n = 1 | 5' end of sense strand | GfgCfuUfgAfgCfaCfCfcaGfgGfaGfsusUf | 4488 | {Phos}csUfscCfCfUfggugCfuCfaAfgCfcsUfsu | 4661 |
| D-3832 | Formula XVI, k = 3, n = 1 | 5' end of sense strand | GfaAfgAfaAfgAfUfUfgAfagUfcGfcUfsusUf | 4489 | {Phos}asGfscGfaCfUfucauCftUfucUfcsUfsu | 4662 |
| D-3833 | Formula XVI, k = 3, n = 1 | 5' end of sense strand | GfaGfaUfgCfcAfCfGfUfuuGfgCfgUfsusUf | 4490 | {Phos}asCfsgCfAfAfacguGfgCfaUfcUfcsUfsu | 4663 |
| D-3834 | Formula XVI, k = 3, n = 1 | 5' end of sense strand | CfgGfgAfcGfgAfCfUfUfAfcgAfgAfcGfsusUf | 4491 | {Phos}csGfscfuCfgfuaguCfcGfuCfcCfgsUfsu | 4664 |

TABLE 8-continued

GalNAc-ASGR1 siRNA Conjugates

| Duplex No. | GalNAc Moiety Conjug. | Site of GalNAc Moiety Conjug. | Sense Sequence (5'-3') | SEQ ID NO: | Antisense Sequence (5'-3') | SEQ ID NO: |
|---|---|---|---|---|---|---|
| D-3835 | Formula XVI, k = 3, n = 1 | 5' end of sense strand | CfuAfcGfaGfaCfGfGfGfcuUfcAfaGfsusUf | 4492 | {Phos}csUfsuGfaAfGfcccgUfcUfcGfuAfgsUfsu | 4665 |
| D-3836 | Formula XVI, k = 3, n = 1 | 5' end of sense strand | CfcCfgGfgCfacUfGfGfagAfaGfcCfsusUf | 4493 | {Phos}gsGfscAfuCfUfccagUfcUfcCfgGfgsUfsu | 4666 |
| D-3837 | Formula XVI, k = 3, n = 1 | 5' end of sense strand | UfgAfaAfcCfcGfuFgGfcgCfuUfuCfsusUf | 4494 | {Phos}gsAfsaAfgCfGfccacGfgGfuFuCfasUfsu | 4667 |
| D-3838 | Formula XVI, k = 3, n = 1 | 5' end of sense strand | GfgUfgGfucCfacGfUfCfcuGfgGfaGfsusUf | 4495 | {Phos}csUfscCfcAfGfgcsgUfgAfcCfaCfcsUfsu | 4668 |
| D-3839 | Formula XVI, k = 3, n = 1 | 5' end of sense strand | CfaGfaAfaAfuUfuFGfUfCfcaGfcAfcCfsusUf | 4496 | {Phos}gsGfsuGfcUfGfgacaAfaUfuUfcUfgsUfsu | 4669 |
| D-3840 | Formula XVI, k = 3, n = 1 | 5' end of sense strand | AfuGfcCfacCfgUfUfUfGfgcGfuGfcUfsusUf | 4497 | {Phos}asGfscAfcGfCfcaaaCfgUfgGfcAfusUfsu | 4670 |
| D-3841 | Formula XVI, k = 3, n = 1 | 5' end of sense strand | AfgCfuGfcGfgGfGfCfcugAfgAfgAfsusUf | 4498 | {Phos}usCfsuCfuCfAfggcCfcGfcAfgCfusUfsu | 4671 |
| D-3842 | Formula XVI, k = 3, n = 1 | 5' end of sense strand | GfcCfcUfaUfcAfUfgGfAfccAfaGfgAfsusUf | 4499 | {Phos}usCfscUfuGfGfucauGfaUfaGfgGfcUfsu | 4672 |
| D-3843 | Formula XVI, k = 3, n = 1 | 5' end of sense strand | AfgCfaAfcUfucCfaFcCfAfgcGfaGfcAfsusUf | 4500 | {Phos}usGfscUfcGfCfugugAfaGfuUfgCfusUfsu | 4673 |

TABLE 8-continued

GalNAc-ASGR1 siRNA Conjugates

| Duplex No. | GalNAc Moiety Conjug. | Site of GalNAc Moiety Conjug. | Sense Sequence (5'-3') | SEQ ID NO: | Antisense Sequence (5'-3') | SEQ ID NO: |
|---|---|---|---|---|---|---|
| D-3844 | Formula XVI, k = 3, n = 1 | 5' end of sense strand | AfgCfaGfaAfaUfUfUfGffucCfaGfcAfsusUf | 4501 | {Phos}usGfscUfgGfAfcaaaUfuUfcUfgCfsusUfsu | 4674 |
| D-3845 | Formula XVI, k = 3, n = 1 | 5' end of sense strand | AfaAfaCfgGfgCfcCfCfUfggAfaGfuGfsusUf | 4502 | {Phos}csAfsUfcUfCfcagggCfcCfgUfuUfusUfsu | 4675 |
| D-3846 | Formula XVI, k = 3, n = 1 | 5' end of sense strand | GfcCfuGfaGfcUfgUfCfagAfuGfgCfsusUf | 4503 | {Phos}gsCfscAfucUfUfgacaGfcUfcAfgGfcsUfsu | 4676 |
| D-3847 | Formula XVI, k = 3, n = 1 | 5' end of sense strand | UfggCfaGfaUfgCfcfAfCfguUfuUfgCfsusUf | 4504 | {Phos}gsCfscAfaAfCfguggCfaUfCfccAfasUfsu | 4677 |
| D-3848 | Formula XVI, k = 3, n = 1 | 5' end of sense strand | AfcUfaCfgAfgAfcCfGfGfgCfgcUfcAfsusUf | 4505 | {Phos}usUfsgAfaGfCfccguCfuCfgUfaGfusUfsu | 4678 |
| D-3849 | Formula XVI, k = 3, n = 1 | 5' end of sense strand | AfaGfuGfgGfuGfgfAfCfggGfacGfgsusUf | 4506 | {Phos}csCfsgUfcCfCfguccAfcCfcAfcUfusUfsu | 4679 |
| D-3850 | Formula XVI, k = 3, n = 1 | 5' end of sense strand | UfgCfaCfaGfcAfCfUfGfaaGfaAfcCfsusUf | 4507 | {Phos}gsGfsuUfCfUfcagugCfUfgUfgCfasUfsu | 4680 |
| D-3851 | Formula XVI, k = 3, n = 1 | 5' end of sense strand | AfcGfgAfcUfaCfgAfGfGfcGfgCfcUfsusUf | 4508 | {Phos}asGfscCfcUfcucgUfaGfucCfgGfusUfsu | 4681 |
| D-3852 | Formula XVI, k = 3, n = 1 | 5' end of sense strand | GfaAfcGfacUfgGfUfAfcgGfcCfacfsusUf | 4509 | {Phos}gsUfsgGfCfgfuaccAfgUfcGfuCfcsUfsu | 4682 |

TABLE 8-continued

GalNAc-ASGR1 siRNA Conjugates

| Duplex No. | GalNAc Moiety | Site of GalNAc Moiety Conjug. | Sense Sequence (5'-3') | SEQ ID NO: | Antisense Sequence (5'-3') | SEQ ID NO: |
|---|---|---|---|---|---|---|
| D-3853 | Formula XVI, k = 3, n = 1 | 5' end of sense strand | GfaGfcUfgCfgGfgGfcCfcuGfaGfaGfsusUf | 4510 | {Phos}csUfsCUfcAfgfgccCfgCfaGfcUfcsUfsu | 4683 |
| D-3854 | Formula XVI, k = 3, n = 1 | 5' end of sense strand | CfaCfgUfuUfgCfcCfgCfUfgcUfuGfgAfsusUf | 4511 | {Phos}usCfscAfaGfCfacgcCfaAfaCfgUfgsUfsu | 4684 |
| D-3855 | Formula XVI, k = 3, n = 1 | 5' end of sense strand | GfuGfgGfaAfgAfAfAfGfauGfaAfgUfsusUf | 4439 | {Phos}[invAbs]asCfsuUfcAfUfcuuuCfuUfcCfcAfcsUfsu | 4685 |
| D-3856 | Formula XVI, k = 3, n = 1 | 5' end of sense strand | GfuGfgGfaAfgAfAfAfGfauGfaAfgUfsusUf | 4439 | {Phos}[invAbs]asCfsuUfcAfUfcuuuCfuUfcCfcAfcUfus{invAb} | 4686 |
| D-3857 | Formula XVI, k = 3, n = 1 | 5' end of sense strand | GfuGfgGfaaGfAfAfAfgAfuGfaAfgUfsusUf | 4512 | {Phos}asCfsuUfcAfuCfuuuUfCfcCfcAfcsUfsu | 4687 |

The efficacy of the GalNAc-siRNA conjugates for inhibiting ASGR1 expression was tested in the Hep3B cell transfection immunoassay (described in Example 2) and/or the human ASGR1 CHO cell free uptake immunoassay (described in Example 7). The results of the assays are shown in Table 9 below.

TABLE 9

Efficacy of GalNac-ASGR1 siRNA conjugates in vitro

| Target site of antisense sequence within NM_001671.4 | Target site of antisense sequence within NM_1197216.2 | Duplex No. | Hep3B Transfected IC50 IP (μM) | Hep3B Transfected Max Antagonist Activity | hASGR1 CHO Free Uptake IC50 IP (μM) | hASGR1 CHO Free Uptake Max Antagonist Activity |
|---|---|---|---|---|---|---|
| 692-710 | 575-593 | D-3651 | 0.00141 | −0.90 | >0.5 | −0.51 |
| 692-710 | 575-593 | D-3652 | 0.00239 | −0.97 | >0.5 | −0.34 |
| 692-710 | 575-593 | D-3653 | 0.00115 | −0.84 | >0.5 | −0.42 |
| 692-710 | 575-593 | D-3654 | 0.00206 | −0.89 | >0.5 | −0.32 |
| 692-710 | 575-593 | D-3655 | 0.00461 | −0.77 | >0.5 | −0.15 |
| 692-710 | 575-593 | D-3656 | 0.00476 | −0.97 | >0.5 | −0.13 |
| 692-710 | 575-593 | D-3657 | 0.00431 | −0.83 | >0.5 | −0.10 |
| 692-710 | 575-593 | D-3658 | 0.00231 | −0.96 | >0.5 | −0.35 |
| 692-710 | 575-593 | D-3659 | 0.00177 | −0.90 | >0.5 | −0.48 |
| 888-906 | 771-789 | D-3660 | 0.00398 | −0.62 | >0.5 | −0.04 |
| 888-906 | 771-789 | D-3661 | >12.5 | −0.4 | >25.0 | −0.30 |
| 888-906 | 771-789 | D-3662 | >12.5 | 0.0 | >25.0 | −0.10 |
| 888-906 | 771-789 | D-3663 | 0.00309 | −0.9 | >25.0 | −0.20 |
| 888-906 | 771-789 | D-3664 | 0.00229 | −0.7 | >25.0 | 0.10 |
| 888-906 | 771-789 | D-3665 | 0.000862 | −0.7 | >25.0 | 0.00 |
| 888-906 | 771-789 | D-3666 | 0.000545 | −0.8 | >25.0 | 0.10 |
| 888-906 | 771-789 | D-3667 | 0.000716 | −0.8 | >25.0 | 0.10 |
| 888-906 | 771-789 | D-3668 | 0.00358 | −0.8 | >25.0 | 0.10 |
| 888-906 | 771-789 | D-3669 | >12.5 | −0.5 | >25.0 | −0.10 |
| 888-906 | 771-789 | D-3670 | >12.5 | −0.3 | >25.0 | 0.10 |
| 888-906 | 771-789 | D-3671 | >12.5 | −0.1 | >25.0 | −0.10 |
| 888-906 | 771-789 | D-3672 | 0.00156 | −0.7 | >25.0 | 0.10 |
| 888-906 | 771-789 | D-3673 | >12.5 | −0.2 | >25.0 | −0.20 |
| 691-709 | 574-592 | D-3674 | 0.59834 | −0.9 | >25.0 | −0.10 |
| 691-709 | 574-592 | D-3675 | 1 | −0.5 | >25.0 | −0.10 |
| 691-709 | 574-592 | D-3676 | 0.24304 | −0.7 | >25.0 | −0.10 |
| 691-709 | 574-592 | D-3677 | 1.99 | −0.9 | >25.0 | −0.30 |
| 692-710 | 575-593 | D-3678 | 0.0085575 | −1.0 | 1.26 | −0.40 |
| 888-906 | 771-789 | D-3679 | 0.33276 | −0.8 | 0.00324 | −0.20 |
| 691-709 | 574-592 | D-3680 | 0.079157 | −1.0 | >12.5 | 0.00 |
| 1158-1176 | 1041-1059 | D-3681 | 0.02749 | −0.8 | >12.5 | −0.20 |
| 1088-1106 | 971-989 | D-3682 | 0.0064167 | −1.0 | 9.4 | −0.30 |
| 884-902 | 767-785 | D-3683 | 0.0057367 | −0.9 | >12.5 | −0.30 |
| 563-581 | — | D-3684 | 0.18997 | −1.0 | 5.48 | −0.20 |
| 604-622 | 487-505 | D-3685 | 0.070325 | −0.9 | 0.306 | −0.10 |
| 1185-1203 | 1068-1086 | D-3686 | 0.25317 | −0.9 | >12.5 | −0.10 |
| 1221-1239 | 1104-1122 | D-3687 | 0.012227 | −0.9 | >12.5 | 0.10 |
| 1349-1367 | 1232-1250 | D-3688 | 0.002845 | −1.0 | >12.5 | −0.20 |
| 547-565 | — | D-3689 | 0.009105 | −0.8 | >12.5 | −0.20 |
| 396-414 | 396-414 | D-3690 | 0.003015 | −1.0 | >12.5 | −0.10 |
| 978-996 | 861-879 | D-3691 | 0.24201 | −0.9 | >12.5 | 0.10 |
| 1334-1352 | 1217-1235 | D-3692 | 0.10186 | −0.9 | >12.5 | −0.10 |
| 395-413 | 395-413 | D-3693 | 0.081347 | −0.9 | >12.5 | −0.10 |
| 1393-1411 | 1276-1294 | D-3694 | 0.58738 | −1.0 | >12.5 | 0.10 |
| 1443-1461 | 1326-1344 | D-3695 | 0.015662 | −0.9 | >12.5 | 0.20 |
| 692-710 | 575-593 | D-3696 | >12.5 | 0.1 | >25.0 | −0.30 |
| 888-906 | 771-789 | D-3697 | 0.00389 | −0.7 | >25.0 | 0.00 |
| 691-709 | 574-592 | D-3698 | >12.5 | −0.2 | >25.0 | −0.10 |
| 692-710 | 575-593 | D-3699 | 0.00324 | −0.9 | 0.638 | −0.40 |
| 888-906 | 771-789 | D-3700 | >12.5 | −0.6 | >25.0 | 0.10 |
| 691-709 | 574-592 | D-3701 | >12.5 | −0.5 | >25.0 | 0.10 |
| 1073-1091 | 956-974 | D-3702 | 0.009365 | −0.8 | >12.5 | −0.30 |
| 1260-1278 | 1143-1161 | D-3703 | >0.195 | −0.4 | >12.5 | −0.20 |
| 796-814 | 679-697 | D-3704 | >12.5 | −0.3 | >12.5 | −0.20 |
| 526-544 | — | D-3705 | >12.5 | −0.2 | >12.5 | −0.10 |
| 523-541 | — | D-3706 | >12.5 | −0.2 | >12.5 | −0.20 |
| 891-909 | 774-792 | D-3707 | 0.00932 | −0.6 | >12.5 | −0.20 |
| 288-306 | 288-306 | D-3708 | 2.22 | −0.5 | >12.5 | −0.20 |
| 897-915 | 780-798 | D-3709 | 0.0129 | −0.8 | >12.5 | −0.20 |
| 1073-1091 | 956-974 | D-3710 | 0.00656 | −0.9 | >12.5 | −0.20 |
| 1260-1278 | 1143-1161 | D-3711 | >12.5 | −0.2 | >12.5 | −0.10 |
| 880-898 | 763-781 | D-3712 | 0.00684 | −0.6 | >12.5 | −0.20 |
| 886-904 | 769-787 | D-3713 | 0.0102 | −0.7 | >12.5 | −0.20 |
| 1074-1092 | 957-975 | D-3714 | 0.005445 | −0.8 | >12.5 | −0.30 |
| 772-790 | 655-673 | D-3715 | >12.5 | −0.2 | >12.5 | −0.20 |
| 796-814 | 679-697 | D-3716 | >12.5 | −0.3 | >12.5 | −0.40 |
| 607-625 | 490-508 | D-3717 | >12.5 | −0.3 | >12.5 | −0.20 |
| 1172-1190 | 1055-1073 | D-3718 | >12.5 | 0.0 | >12.5 | −0.20 |

TABLE 9-continued

Efficacy of GalNac-ASGR1 siRNA conjugates in vitro

| Target site of antisense sequence within NM_001671.4 | Target site of antisense sequence within NM_1197216.2 | Duplex No. | Hep3B Transfected IC50 IP (μM) | Hep3B Transfected Max Antagonist Activity | hASGR1 CHO Free Uptake IC50 IP (μM) | hASGR1 CHO Free Uptake Max Antagonist Activity |
|---|---|---|---|---|---|---|
| 1042-1060 | 925-943 | D-3719 | >0.0488 | −0.6 | >12.5 | −0.20 |
| 526-544 | — | D-3720 | >12.5 | −0.2 | >12.5 | −0.10 |
| 523-541 | — | D-3721 | >12.5 | −0.2 | >12.5 | −0.10 |
| 694-712 | 577-595 | D-3722 | 0.0051033 | −0.9 | >12.5 | −0.20 |
| 1168-1186 | 1051-1069 | D-3723 | >0.195 | −0.5 | >12.5 | −0.20 |
| 891-909 | 774-792 | D-3724 | 0.00819 | −0.9 | >12.5 | −0.30 |
| 1052-1070 | 935-953 | D-3725 | >12.5 | −0.2 | >12.5 | −0.20 |
| 1116-1134 | 99-1017 | D-3726 | 0.00546 | −0.5 | >12.5 | −0.50 |
| 1228-1246 | 1111-1129 | D-3727 | 0.006855 | −0.9 | >12.5 | −0.50 |
| 952-970 | 835-853 | D-3728 | >12.5 | −0.2 | >12.5 | −0.30 |
| 975-993 | 858-876 | D-3729 | >12.5 | −0.1 | >12.5 | −0.20 |
| 850-868 | 733-751 | D-3730 | >12.5 | −0.1 | >3.13 | −0.20 |
| 288-306 | 288-306 | D-3731 | 0.0106 | −0.7 | >12.5 | −0.10 |
| 1034-1052 | 917-935 | D-3732 | 4.07 | −0.5 | >12.5 | 0.20 |
| 1180-1198 | 1063-1081 | D-3733 | 0.0311 | −0.4 | >12.5 | −0.20 |
| 897-915 | 780-798 | D-3734 | 0.005955 | −0.9 | >12.5 | −0.20 |
| 1045-1063 | 928-946 | D-3735 | >1.56 | −0.6 | >12.5 | −0.40 |
| 1225-1243 | 1108-1126 | D-3736 | >0.0488 | −0.6 | >12.5 | −0.30 |
| 1073-1091 | 956-974 | D-3737 | 0.086915 | −0.7 | >12.5 | −0.20 |
| 1260-1278 | 1143-1161 | D-3738 | 0.68126 | −0.9 | >12.5 | −0.10 |
| 796-814 | 679-697 | D-3739 | 0.024703 | −0.9 | >12.5 | −0.30 |
| 526-544 | — | D-3740 | >12.5 | −0.5 | >12.5 | −0.10 |
| 523-541 | — | D-3741 | 0.0982 | −0.8 | >12.5 | −0.10 |
| 891-909 | 774-792 | D-3742 | 0.07107 | −0.6 | >12.5 | 0.10 |
| 288-306 | 288-306 | D-3743 | 0.025805 | −0.6 | >12.5 | −0.10 |
| 897-915 | 780-798 | D-3744 | 0.03467 | −0.8 | >12.5 | 0.10 |
| 888-906 | 771-789 | D-3745 | 0.000851 | −1.0 | ND | ND |
| 692-710 | 575-593 | D-3746 | 0.00158 | −0.9 | ND | ND |
| 692-710 | 575-593 | D-3747 | 0.00289 | −0.6 | ND | ND |
| 692-710 | 575-593 | D-3748 | 0.0301 | −0.6 | ND | ND |
| 692-710 | 575-593 | D-3749 | 0.00133 | −0.9 | ND | ND |
| 692-710 | 575-593 | D-3750 | 0.00327 | −0.6 | ND | ND |
| 692-710 | 575-593 | D-3751 | 0.0043167 | −1.0 | 0.0193 | −0.70 |
| 692-710 | 575-593 | D-3752 | 0.00545 | −0.9 | 0.0507 | −0.50 |
| 692-710 | 575-593 | D-3753 | 0.00918 | −1.0 | >25.0 | 0.10 |
| 692-710 | 575-593 | D-3754 | 0.0029367 | −1.0 | >25.0 | 0.10 |
| 692-710 | 575-593 | D-3755 | 0.00034033 | −0.9 | >25.0 | 0.20 |
| 692-710 | 575-593 | D-3756 | 0.0276 | −0.5 | >25.0 | 0.10 |
| 692-710 | 575-593 | D-3757 | 0.014369 | −1.0 | >25.0 | 0.10 |
| 888-906 | 771-789 | D-3758 | 0.0029492 | −0.9 | >0.5 | −0.20 |
| 691-709 | 574-592 | D-3759 | 0.022895 | −0.8 | >0.5 | 0.10 |
| 692-710 | 575-593 | D-3760 | 0.0010037 | −0.8 | ND | ND |
| 888-906 | 771-789 | D-3761 | >0.0156 | −0.3 | ND | ND |
| 692-710 | 575-593 | D-3762 | 0.002224 | −0.7 | ND | ND |
| 692-710 | 575-593 | D-3763 | 0.001353 | −0.8 | ND | ND |
| 692-710 | 575-593 | D-3764 | >0.5 | 0.1 | ND | ND |
| 692-710 | 575-593 | D-3765 | 0.0009435 | −0.8 | ND | ND |
| 692-710 | 575-593 | D-3766 | 0.000828 | −0.7 | ND | ND |
| 692-710 | 575-593 | D-3767 | 0.0037575 | −0.9 | 0.01547 | −0.80 |
| 692-710 | 575-593 | D-3768 | 0.024725 | −0.9 | 0.0662 | −0.60 |
| 692-710 | 575-593 | D-3769 | 0.00231 | −0.4 | 0.0265 | −0.20 |
| 692-710 | 575-593 | D-3770 | >0.5 | −0.5 | ND | ND |
| 692-710 | 575-593 | D-3771 | 0.001805 | −0.8 | ND | ND |
| 692-710 | 575-593 | D-3772 | 0.001135 | −0.9 | ND | ND |
| 888-906 | 771-789 | D-3773 | 0.003285 | −1.0 | ND | ND |
| 692-710 | 575-593 | D-3774 | 0.004225 | −1.0 | 0.0415 | −0.60 |
| 692-710 | 575-593 | D-3775 | 0.003205 | −0.9 | 0.03335 | −0.50 |
| 888-906 | 771-789 | D-3776 | 0.25585 | −0.7 | >12.5 | −0.20 |
| 888-906 | 771-789 | D-3777 | 0.12353 | −1.0 | >12.5 | −0.30 |
| 888-906 | 771-789 | D-3778 | 0.00263 | −0.76 | ND | ND |
| 1185-1203 | 1068-1086 | D-3779 | >0.391 | −0.58 | ND | ND |
| 1393-1411 | 1276-1294 | D-3780 | 0.00496 | −0.82 | ND | ND |
| 395-413 | 395-413 | D-3781 | >0.195 | −0.55 | ND | ND |
| 396-414 | 396-414 | D-3782 | 0.00437 | −0.79 | ND | ND |
| 1052-1070 | 935-953 | D-3783 | >0.0977 | −0.39 | ND | ND |
| 1073-1091 | 956-974 | D-3784 | 0.00799 | −0.69 | ND | ND |
| 1074-1092 | 957-975 | D-3785 | 0.011 | −0.66 | ND | ND |
| 1116-1134 | 99-1017 | D-3786 | >12.5 | −0.38 | ND | ND |
| 1168-1186 | 1051-1069 | D-3787 | >12.5 | −0.30 | ND | ND |
| 1180-1198 | 1063-1081 | D-3788 | 0.00817 | −0.70 | ND | ND |
| 1425-1444 | 1308-1327 | D-3789 | 0.00365 | −0.48 | ND | ND |
| 1341-1359 | 1224-1242 | D-3790 | >6.25 | −0.74 | ND | ND |
| 1424-1443 | 1307-1326 | D-3791 | 0.00241 | −0.74 | ND | ND |

TABLE 9-continued

Efficacy of GalNac-ASGR1 siRNA conjugates in vitro

| Target site of antisense sequence within NM_001671.4 | Target site of antisense sequence within NM_1197216.2 | Duplex No. | Hep3B Transfected IC50 IP (µM) | Hep3B Transfected Max Antagonist Activity | hASGR1 CHO Free Uptake IC50 IP (µM) | hASGR1 CHO Free Uptake Max Antagonist Activity |
|---|---|---|---|---|---|---|
| 991-1009 | 874-892 | D-3792 | >12.5 | −0.35 | ND | ND |
| 1081-1099 | 964-982 | D-3793 | >12.5 | −0.27 | ND | ND |
| 1164-1182 | 1047-1065 | D-3794 | >12.5 | −0.46 | ND | ND |
| 563-581 | — | D-3795 | 0.00349 | −0.77 | ND | ND |
| 1225-1243 | 1108-1126 | D-3796 | >0.781 | −0.43 | ND | ND |
| 1260-1278 | 1143-1161 | D-3797 | >0.781 | −0.63 | ND | ND |
| 772-790 | 655-673 | D-3798 | >0.781 | −0.39 | ND | ND |
| 886-904 | 769-787 | D-3799 | 0.0108 | −0.76 | ND | ND |
| 891-909 | 774-792 | D-3800 | 0.0039 | −0.80 | ND | ND |
| 897-915 | 780-798 | D-3801 | 0.00575 | −0.76 | ND | ND |
| 888-906 | 771-789 | D-3802 | 0.00406 | −0.95 | >0.5 | 0.09 |
| 888-906 | 771-789 | D-3803 | 0.01116 | −0.91 | >0.5 | −0.08 |
| 888-906 | 771-789 | D-3804 | 0.00477 | −0.97 | >0.5 | −0.07 |
| 692-710 | 575-593 | D-3805 | >0.5 | 0.07 | >0.5 | −0.08 |
| 692-710 | 575-593 | D-3806 | >0.5 | 0.13 | >0.5 | 0.04 |
| 692-710 | 575-593 | D-3807 | >0.5 | 0.15 | >0.5 | −0.18 |
| 692-710 | 575-593 | D-3813 | ND | ND | 0.02753 | −0.69 |
| 692-710 | 575-593 | D-3814 | ND | ND | 0.00708 | −0.70 |
| 692-710 | 575-593 | D-3815 | ND | ND | 0.00987 | −0.49 |
| 692-710 | 575-593 | D-3816 | ND | ND | No curve fit | 0.074826181 |
| 692-710 | 575-593 | D-3817 | ND | ND | 0.02035 | −0.65 |
| 692-710 | 575-593 | D-3818 | ND | ND | 0.02340 | −0.68 |
| 692-710 | 575-593 | D-3819 | ND | ND | 0.01316 | −0.70 |
| 692-710 | 575-593 | D-3820 | ND | ND | 0.02094 | −0.75 |
| 692-710 | 575-593 | D-3821 | ND | ND | 0.03345 | −0.75 |
| 692-710 | 575-593 | D-3822 | ND | ND | 0.03030 | −0.65 |
| 692-710 | 575-593 | D-3823 | ND | ND | 0.05948 | −0.72 |
| 692-710 | 575-593 | D-3824 | ND | ND | 0.01883 | −0.43 |
| 692-710 | 575-593 | D-3825 | ND | ND | 0.01320 | −0.80 |
| 692-710 | 575-593 | D-3826 | ND | ND | 0.07031 | −0.76 |
| 692-710 | 575-593 | D-3827 | ND | ND | 0.02455 | −0.61 |
| 1186-1205 | 1069-1088 | D-3828 | ND | ND | No curve fit | 0.07 |
| 170-189 | 170-189 | D-3829 | ND | ND | No curve fit | 0.14 |
| 673-692 | 556-575 | D-3830 | ND | ND | No curve fit | 0.18 |
| 668-687 | 551-570 | D-3831 | ND | ND | No curve fit | 0.188 |
| 696-715 | 579-598 | D-3832 | ND | ND | 0.01483 | −0.78 |
| 168-187 | 168-187 | D-3833 | ND | ND | No curve fit | 0.17 |
| 1075-1094 | 958-977 | D-3834 | ND | ND | No curve fit | 0.13 |
| 1084-1103 | 967-986 | D-3835 | ND | ND | No curve fit | 0.20 |
| 157-176 | 157-176 | D-3836 | ND | ND | No curve fit | −0.20 |
| 1423-1442 | 1306-1325 | D-3837 | ND | ND | No curve fit | 0.13 |
| 970-989 | 853-872 | D-3838 | ND | ND | No curve fit | 0.16 |
| 992-1011 | 875-894 | D-3839 | ND | ND | No curve fit | 0.17 |
| 171-190 | 171-190 | D-3840 | ND | ND | No curve fit | −0.09 |
| 606-625 | 489-508 | D-3841 | ND | ND | No curve fit | 0.06 |
| 393-412 | 393-412 | D-3842 | ND | ND | No curve fit | 0.08 |
| 0632-0651 | 515-534 | D-3843 | ND | ND | No curve fit | 0.17 |
| 0990-1009 | 873-892 | D-3844 | ND | ND | 0.11508 | −0.50 |
| 1050-1069 | 933-952 | D-3845 | ND | ND | No curve fit | −0.26 |
| 807-826 | 690-709 | D-3846 | ND | ND | No curve fit | −0.05 |
| 166-185 | 166-185 | D-3847 | ND | ND | No curve fit | 0.19 |
| 1083-1102 | 966-985 | D-3848 | ND | ND | 0.01367 | −0.41 |
| 1064-1083 | 947-966 | D-3849 | ND | ND | No curve fit | 0.17 |
| 328-347 | 328-347 | D-3850 | ND | ND | No curve fit | 0.12 |
| 1079-1098 | 962-981 | D-3851 | ND | ND | No curve fit | 0.09 |
| 1123-1142 | 1006-1025 | D-3852 | ND | ND | No curve fit | −0.04 |
| 605-624 | 488-507 | D-3853 | ND | ND | No curve fit | 0.22 |
| 175-194 | 175-194 | D-3854 | ND | ND | No curve fit | 0.29 |
| 692-710 | 575-593 | D-3855 | ND | ND | No curve fit | 0.14 |
| 692-710 | 575-593 | D-3856 | ND | ND | No curve fit | 0.11 |
| 692-710 | 575-593 | D-3857 | 0.00532 | −0.61 | >0.5 | −0.44 |

Several of the GalNAc-ASGR1 siRNA conjugates were evaluated further for efficacy in knocking down ASGR1 mRNA levels in hepatocytes. Following the manufacturers protocol, human primary hepatocyte cells (Xenotech/Sekisui donor lot #HC3-38) were thawed in OptiThaw media (Xenotech cat #K8000). Cells were centrifuged and post media aspiration, resuspended in OptiPlate hepatocyte media (Xenotech cat #K8200) and plated into 96 well collagen coated plates (Greiner cat #655950). Following a 2-4 hour incubation period, media was removed and replaced with OptiCulture hepatocyte media (Xenotech cat #K8300). 2-4 hours following the addition of OptiCulture media, GalNAc-conjugated siRNAs were delivered to cells via free uptake (no transfection reagent). Cells were incubated 24-72 hours at 37° C. and 5% $CO_2$. Cells were then lysed with Qiagen RLT buffer (79216) +1% 2-mercaptoethanol (Sigma, M-3148), and the lysates were stored at −20° C. RNA was purified using a Qiagen QIACube HT instrument (9001793) and a Qiagen RNeasy 96 QIACube HT Kit (74171) according to manufacturer's instructions. Samples were analyzed using a QIAxpert system (9002340).

cDNA was synthesized from RNA samples using the Applied Biosystems High Capacity cDNA Reverse Transcription kit (4368813), reactions were assembled according to manufacturer's instructions, input RNA concentration varied by sample. Reverse transcription was carried out on a BioRad tetrad thermal cycler (model #PTC-0240G) under the following conditions: 25° C. 10 minutes, 37° C. 120 minutes, 85° C. 5 minutes followed by (an optional) 4° C. infinite hold. Droplet digital PCR (ddPCR) was performed using BioRad's QX200 AutoDG droplet digital PCR system according to manufacturer's instructions. Reactions were assembled into an Eppendorf clear 96 well PCR plate (951020303) using BioRad ddPCR Supermix for Probes (1863010), fluorescently labeled qPCR assays for ASGR1 (IDT Hs.PT.56a.24725395, ordered with primer to probe ratio 3.6:1, 9 nanomoles each forward and reverse primer (sequences listed below), 2.5 nanomoles 6-FAM/ZEN/IBFQ labeled probe (sequence listed below)) and GUSB (IDT Hs.PT.58v.27737538, ordered with primer to probe ratio 3.6:1, 9 nanomoles each forward and reverse primer (sequences listed below), 2.5 nanomoles HEX/ZEN/IBFQ labeled probe (sequence listed below)) and RNase free water (Ambion, AM9937). Final primer/probe concentration was 900 nM/250 nM respectively, input cDNA concentration varied among wells.

Droplets were formed using a BioRad Auto DG droplet generator (1864101) set up with manufacturer recommended consumables (BioRad DG32 cartridges 1864108, BioRad tips 1864121, Eppendorf blue 96 well PCR plate 951020362, BioRad droplet generation oil for probes 1864110 and a BioRad droplet plate assembly). Droplets were amplified on a BioRad C1000 touch thermal cycler (1851197) using the following conditions: enzyme activation 95° C. 10 minutes, denaturation 94° C. 30 seconds followed by annealing/extension 60° C. for one minute, 40 cycles using a 2° C./second ramp rate, enzyme deactivation 98° C. 10 minutes followed by (an optional) 4° C. infinite hold. Samples were then read on a BioRad QX200 Droplet Reader measuring FAM/HEX signal that correlated to ASGR1 or GUSB concentration, respectively. Data was analyzed using BioRad's QuantaSoft software package. Samples were gated by channel (fluorescent label) to determine the concentration per sample. Each sample was then expressed as the ratio of the concentration of the gene of interest (ASGR1)/concentration of the housekeeping gene (GUSB) to control for differences in sample loading. Data was then imported into Genedata Screener, where each test siRNA was normalized to the median of the neutral control wells (buffer only) and was expressed as the POC (percent of control). IC50 and max activity are reported in Table 10 below.

ddPCR Assay Sequences

```
ASGR1:
Primer 1:
                                       (SEQ ID NO: 4688)
CAGGCTGGAGTGATCTTCA Primer 2:
                                       (SEQ ID NO: 4689)
TTCAGCAACTTCACAGCGA
```

-continued

```
Probe:
                                       (SEQ ID NO: 4690)
56-FAM/TCTTTCTTC (SEQ ID NO: 4691)
/ZEN/CCACATTGCCTCCCTG/3IABkFQ/

GUSB:
Primer 1:
                                       (SEQ ID NO: 4692)
GTTTTTGATCCAGACCCAGATG Primer 2:
                                       (SEQ ID NO: 4693)
GCCCATTATTCAGAGCGAGTA Probe:
                                       (SEQ ID NO: 4694)
5HEX/TGCAGGGTT (SEQ ID NO: 4695)
/ZEN/TCACCAGGATCCAC/3IABkFQ/
```

TABLE 10

ASGR1 mRNA in vitro knockdown by select GalNAc-ASGR1 conjugates

| Duplex No. | Primary Human Hepatocyte ddPCR IC50 (µM) | Primary Human Hepatocyte ddPCR Max Activity |
|---|---|---|
| D-3779 | 0.0302 | −0.46 |
| D-3780 | 0.0040 | −0.80 |
| D-3781 | 0.0158 | −0.40 |
| D-3782 | 0.0084 | −0.79 |
| D-3783 | — | −0.19 |
| D-3784 | 0.0281 | −0.42 |
| D-3785 | 0.0249 | −0.40 |
| D-3786 | 0.0267 | −0.32 |
| D-3787 | — | 0.03 |
| D-3788 | 0.0127 | −0.49 |
| D-3789 | — | −0.26 |
| D-3790 | 0.0046 | −0.34 |
| D-3791 | 0.0041 | −0.81 |
| D-3792 | — | −0.03 |
| D-3793 | — | −0.09 |
| D-3794 | — | −0.05 |
| D-3795 | 0.0022 | −0.66 |
| D-3796 | — | 0.17 |
| D-3797 | 0.0875 | −0.45 |
| D-3798 | 0.0114 | −0.38 |
| D-3799 | 0.0135 | −0.36 |
| D-3800 | 0.0094 | −0.73 |
| D-3801 | 0.0159 | −0.57 |

The majority of the tested GalNAc-siRNA conjugates reduced ASGR1 mRNA levels in primary human hepatocytes indicating that the conjugates were effectively delivered to the cells and the siRNAs were active. Compounds D-3780, D-3782, D-3791, D-3795, and D-3800 were the most potent and had the highest maximum inhibitory activity of the conjugates evaluated in this assay. These compounds also exhibited potent inhibiton of ASGR1 protein expression when transfected into Hep3B cells. See Hep3B transfection assay data in Table 9.

Example 9

In Vivo Efficacy of GalNAc-ASGR1 siRNA Conjugates

To assess whether the GalNAc-ASGR1 siRNA conjugates could effectively silence ASGR1 expression in vivo, conjugates exhibiting the best in vitro inhibition as measured by ddPCR (Table 10) were administered to ASGR1 knockout mice expressing the human ASGR1 gene. 10-12 week old ASGR1 knockout mice (The Jackson Laboratory) were i.v. injected with an adeno-associated virus (AAV) encoding the human ASGR1 gene (AAV-hASGR1) at a dose of 1x10$^{12}$ genome copies (GC) per animal. Two weeks following AAV-hASGR1 injection, mice received a s.c. injection of buffer or the indicated GalNAc-siRNA conjugate (compounds D-3752, D-3779, D-3780, D-3782, D-3784, D-3785, D-3788, D-3791, D-3795, D-3797, D-3799, D-3800, and D-3801) at 5 mg/kg body weight in 0.25 ml buffer (n=6 each group). At day 8 following compound administration, three animals in each treatment group were euthanized and harvested for further analysis. The remaining three animals in each treatment group were harvestred at day 15 following compound administration. Serum and livers were collected from all animals. Total RNA isolated from the livers of the animals was processed for qPCR analysis to assess human ASGR1 mRNA levels. Serum levels of alkaline phosphatase (ALP) were measured by a clinical analyzer (AU400 Chemistry Analyzer, Olympus). Elevated levels of ALP in the serum has been reported to correlate with reduced serum levels of non-HDL cholesterol and reduced risk of coronary artery disease (Nioi et al., New England Journal of Medicine, Vol. 374(22):2131-2141, 2016), and thus serves as useful biomarker.

Figure 6A:
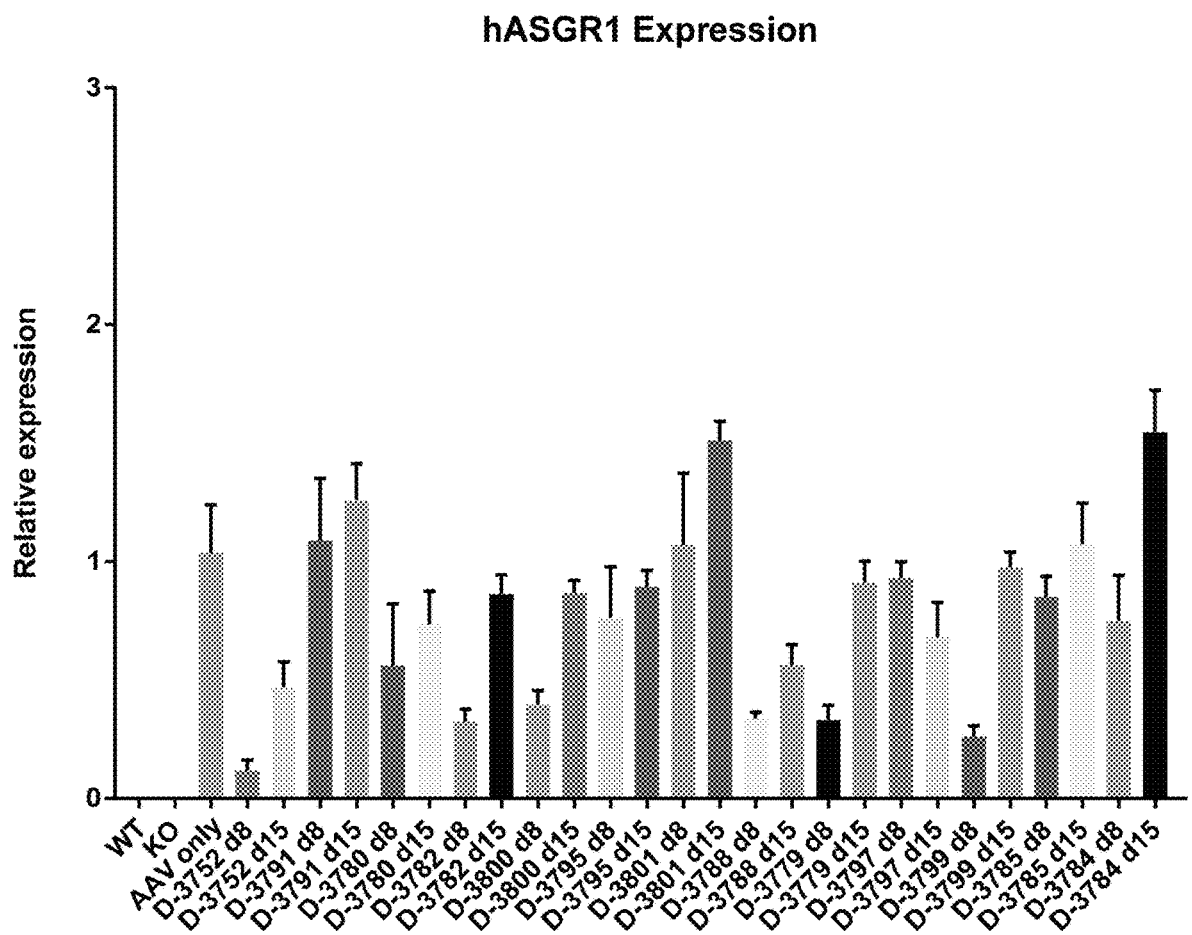
FIG. 6A is a bar graph of human ASGR1 expression levels in livers of ASGR1 knockout mice injected with an AAV encoding human ASGR1 and treated with 5 mg/kg subcutaneous injections of the indicated GalNAc-ASGR1 siRNA conjugates. Human ASGR1 expression was measured by qPCR and is reported as expression levels relative to the AAV only control animals, which were ASGR1 knockout animals injected with the AAV encoding human ASGR1, but were otherwise untreated. Expression levels are shown at day 8 (d8) and day 15 (d15) after GalNAc-siRNA conjugate administration. Wild-type (WT) mice and ASGR1 knockout (KO) animals were included as controls.
Figure 6B:
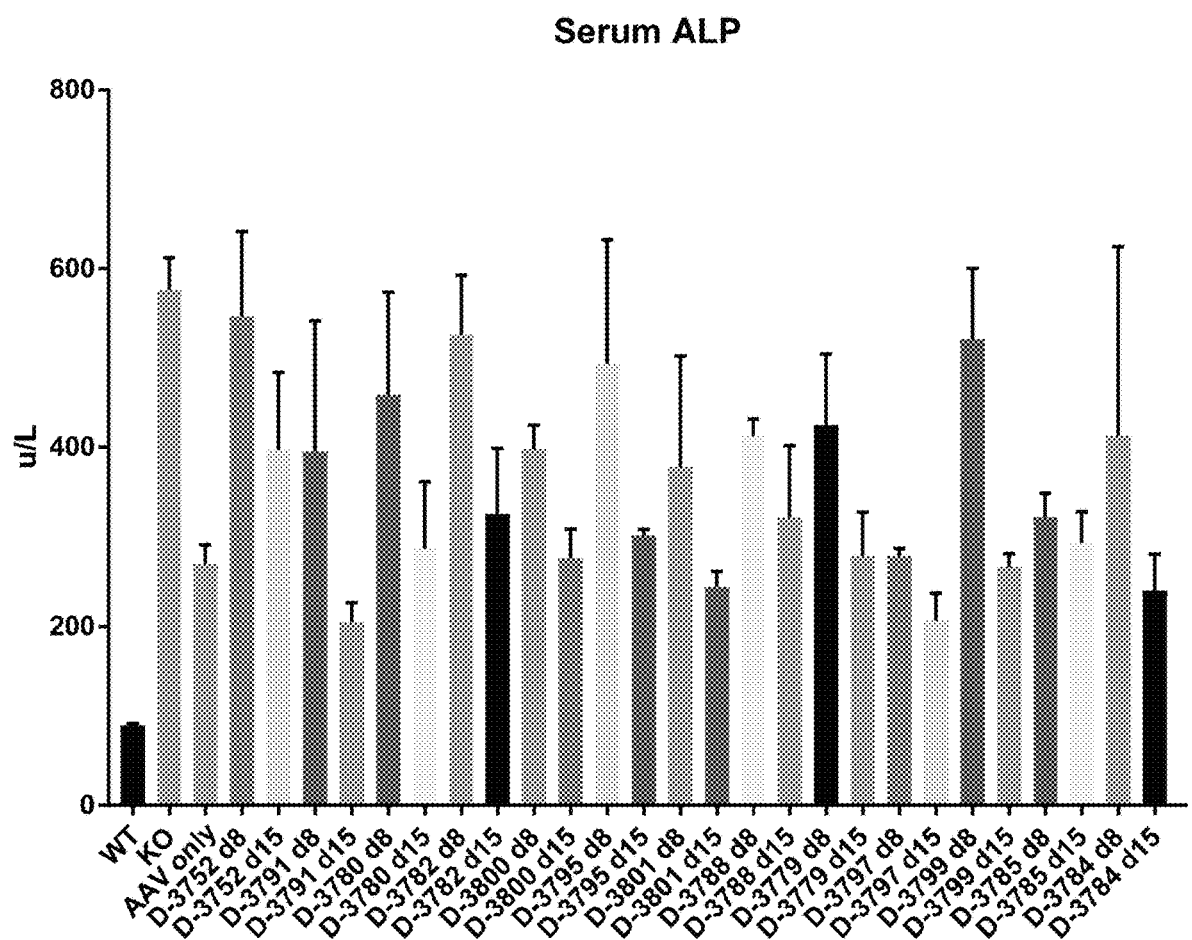
FIG. 6B is a bar graph of serum levels of alkaline phosphatase (ALP) from the animals described in FIG. 6A. Serum was obtained at day 8 (d8) and day 15 (d15) following administration of the indicated GalNAc-siRNA conjugates.

As shown in FIG. 6A, several of the GalNAc-siRNA conjugates reduced human ASGR1 mRNA levels 8 days following administration. Compounds D-3752, D-3779, D-3782, D-3788, D-3799, and D-3800 were particularly effective. Suppression of hASGR1 mRNA levels 15 days following compound administration was observed for some of the compounds. Compounds D-3752 and D-3788 were especially effective at this time point. FIG. 6B shows serum ALP levels at the same time points. Generally, elevation of serum ALP levels correlated with knockdown of hASGR1 mRNA. Some of the compounds (e.g. D-3752, D-3782) produced elevation of serum ALP to levels similar to those observed in ASGR1 knockout animals, which represent maximum inhibition of ASGR1 expression. The results of the in vivo experiments demonstrate that the GalNAc-ASGR1 siRNA conjugates, when administered subcutaneously, effectively suppress ASGR1 gene expression in the liver and modulate serum ALP, a biomarker of efficacy in treating coronary artery disease.

Example 10

ASGR1 Antibody as an Alternative Delivery Mechanism for siRNA Molecules

The purpose of the experiments described in this example was to determine whether a monoclonal antibody against ASGR1 could be used to deliver ASGR1 siRNA molecules to the liver. An anti-ASGR1 monoclonal antibody with an E272C mutation in its heavy chain according to the EU numbering scheme (anti-ASGR1 cys mAb, 200 mg) was incubated with 50 mL solution of 2.5 mM cystamine and 2.5 mM cysteamine in 40 mM HEPES buffer, pH 7.5-8.5 for 15-20 h at RT. The amino acid sequences of the heavy chain and light chain of the anti-ASGR1 antibody are provided below as SEQ ID NOs: 4696 and 4697, respectively. The reaction mixture was filtered using a 0.22 μm filter, and diluted to 250 mL with 100 mM sodium acetate buffer pH 5. Cation exchange chromatography was performed to purify the bis-cysteamine-capped anti-ASGR1 cys mAb from the reaction mixture. First, 250 mL of reaction mixture diluted in 100 mM sodium acetate buffer pH 5 was loaded onto 25 mL SP HP column (GE Healthcare Life Sciences) at 5 mL/min. The column was washed with 2 column volumes (CV) of 100 mM sodium acetate pH 5, followed by a 0-20% gradient of 100 mM sodium acetate with 1.2 M sodium chloride (NaCl) pH 5 over 10 CV. The main peak containing bis-cysteamine-capped anti-ASGR1 cys mAb was collected and buffer exchanged into 10 mM sodium acetate with 9% sucrose pH 5.2 via dialysis.

Anti-ASGR1 Cys mAb Heavy Chain
(SEQ ID NO: 4696)
QVQLVESGGGVVQPGRSLRLSCAASGFTFSSYGMHWVRQAPGKGLEWVAV

IWYDGSNKYYADSVKGRETISRDNSKNTLYLQMNSLRAEDTAVYYCARDS

SPYGMDVWGQGTTVTVSSASTKGPSVFPLAPSSKSTSGGTAALGCLVKDY

FPEPVTVSWNSGALTSGVHTFPAVLQSSGLYSLSSVVTVPSSSLGTQTYI

CNVNHKPSNTKVDKKVEPKSCDKTHTCPPCPAPELLGGPSVFLFPPKPKD

TLMISRTPEVTCVVVDVSHEDPCVKFNWYVDGVEVHNAKTKPCEEQYGST

YRCVSVLTVLHQDWLNGKEYKCKVSNKALPAPIEKTISKAKGQPREPQVY

TLPPSREEMTKNQVSLTCLVKGFYPSDIAVEWESNGQPENNYKTTPPVLD

SDGSFFLYSKLTVDKSRWQQGNVFSCSVMHEALHNHYTQKSLSLSPGK

Anti-ASGR1 Cys mAb Light Chain
(SEQ ID NO: 4697)
DIQMTQSPSSVSASVGDRVTITCRASQGISSWLAWYQQKPGKAPKLLIYG

ASSLQSGVPSRFSASGSGTDFTLTISSLQPEDFATYYCQQSDSFPRTFGQ

GTKVEIKRTVAAPSVFIFPPSDEQLKSGTASVVCLLNNFYPREAKVQWKV

DNALQSGNSQESVTEQDSKDSTYSLSSTLTLSKADYEKHKVYACEVTHQG

LSSPVTKSFNRGEC

Figure 7A:
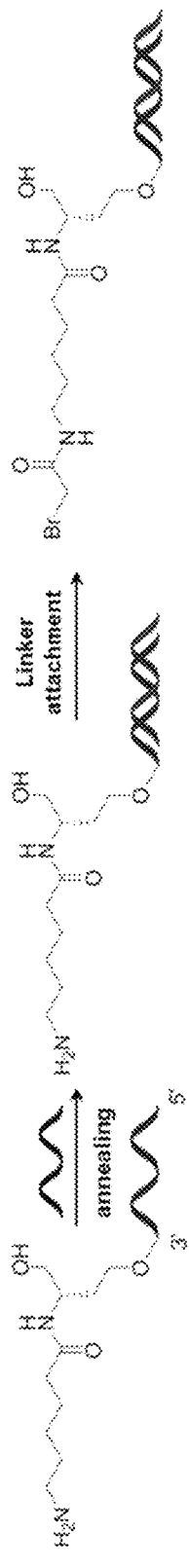
FIG. 7A is a schematic illustrating the reaction to add a bromoacetyl linker to the 3' end of the sense strand of a siRNA duplex.

A siRNA duplex containing a sense strand having a sequence (5' to 3') of GfsusGfgGfaAfgAfAfAfgAfuGfaAf-gUfuUf (SEQ ID NO: 4698) and an antisense strand having a sequence (5' to 3') of asCfsuUfcA-fuCfuuuCfuUfcCfcAfcsUfsu (SEQ ID NO: 4699) was used to generate the mAb-siRNA conjugate. The notations in the sense and antisense sequences are the same as those used for the nucleotide sequences in Tables 6 and 8 described above. The siRNA duplex had a 19 base pair duplex region with a 2 nucleotide overhang at the 3' end of the sense and antisense strands. The sense strand of the siRNA duplex had a homoserine-aminohexanoic acid (hSer-Ahx) modification at its 3' end. The siRNA duplex was formed in 100 mM potassium acetate, 30 mM HEPES-KOH, pH 7.4 upon heating to 90° C. for 5 min and cooling to RT over 30 min. The 3' hSer-Ahx siRNA duplex was further functionalized with a bromoacetyl group using succinimidyl bromoacetate (SBA) (FIG. 7A). The 3' hSer-Ahx siRNA duplex in 100 mM potassium acetate, 30 mM HEPES-KOH, pH 7.4 was incubated with 10-20 equivalents of SBA at RT for 1 h. Then, an additional 10-20 equivalents of SBA were added, and the reaction mixture was incubated at RT for another hour. The reaction was monitored using LC-TOF. Excess SBA was removed from the 3'-bromoacetyl-siRNA by buffer exchanging with 50 mM sodium phosphate, 2 mM ethylenediaminetetraacetic acid (EDTA), pH 7.5 using Amicon-15 3k spin concentrators.

Figure 7B:
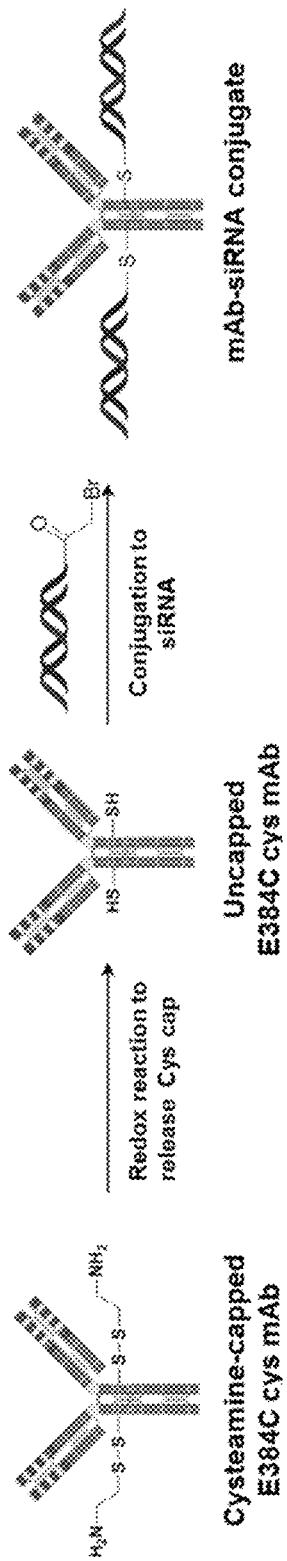
FIG. 7B is a schematic depicting the conjugation reaction to attach a siRNA duplex to an anti-ASGR1 antibody.

Bis-cysteamine-capped anti-ASGR1 cys mAb (~5 mg/mL in 10 mM sodium acetate with 9% sucrose) was partially reduced using 3-4 equivalents of tris(2-carboxyethyl)phosphine (TCEP) or triphenylphosphine-3,3',3"-trisulfonic acid trisodium salt (TPPTS) at RT for 60-90 min (FIG. 7B). The reaction was monitored using analytical cation exchange chromatography. TCEP or TPPTS was removed, and partially reduced cys mAb was buffer exchanged into 50 mM sodium phosphate buffer pH 7.5 containing 2 mM EDTA. To the partially reduced cys mAb was added 6-10 equivalents of dehydroascorbic acid (DHAA), and oxidation was carried out at RT until only trace amount of reduced mAb species were observed (30-180 min). Without removing DHAA, 6 equivalents of bromoacetyl-siRNA duplex were added to the reaction mixture, and the alkylation was carried out at RT for 15-48 h (FIG. 7B). Excess siRNA duplex and small molecule reagents were removed by size exclusion chromatography (SEC) with isocratic flow of 0.17 M potassium phosphate, 0.21 M potassium chloride, 10% (v/v) isopropanol, pH 7. The anti-ASGR1 mAb-siRNA conjugates with RNA-to-antibody ratio (RAR) of 1 and 2 were separated using anion exchange chromatography. The SEC pool was diluted in 20 mM Tris-HCl pH 7, 100 mM NaCl and loaded onto Q HP column (GE Healthcare Life Sciences). The column was washed with 5 CV of 20 mM Tris-HCl pH 7, 100 mM NaCl, followed by a gradient elution with 20 mM Tris-HCl pH 7 containing 0.4 to 1 M NaCl over 20 CV. The purified RAR1 (compound 3549) and RAR2 (compound 3550) products were buffer exchanged into Dulbecco's phosphate-buffered saline (DPBS) using spin concentration.

Figure 8:
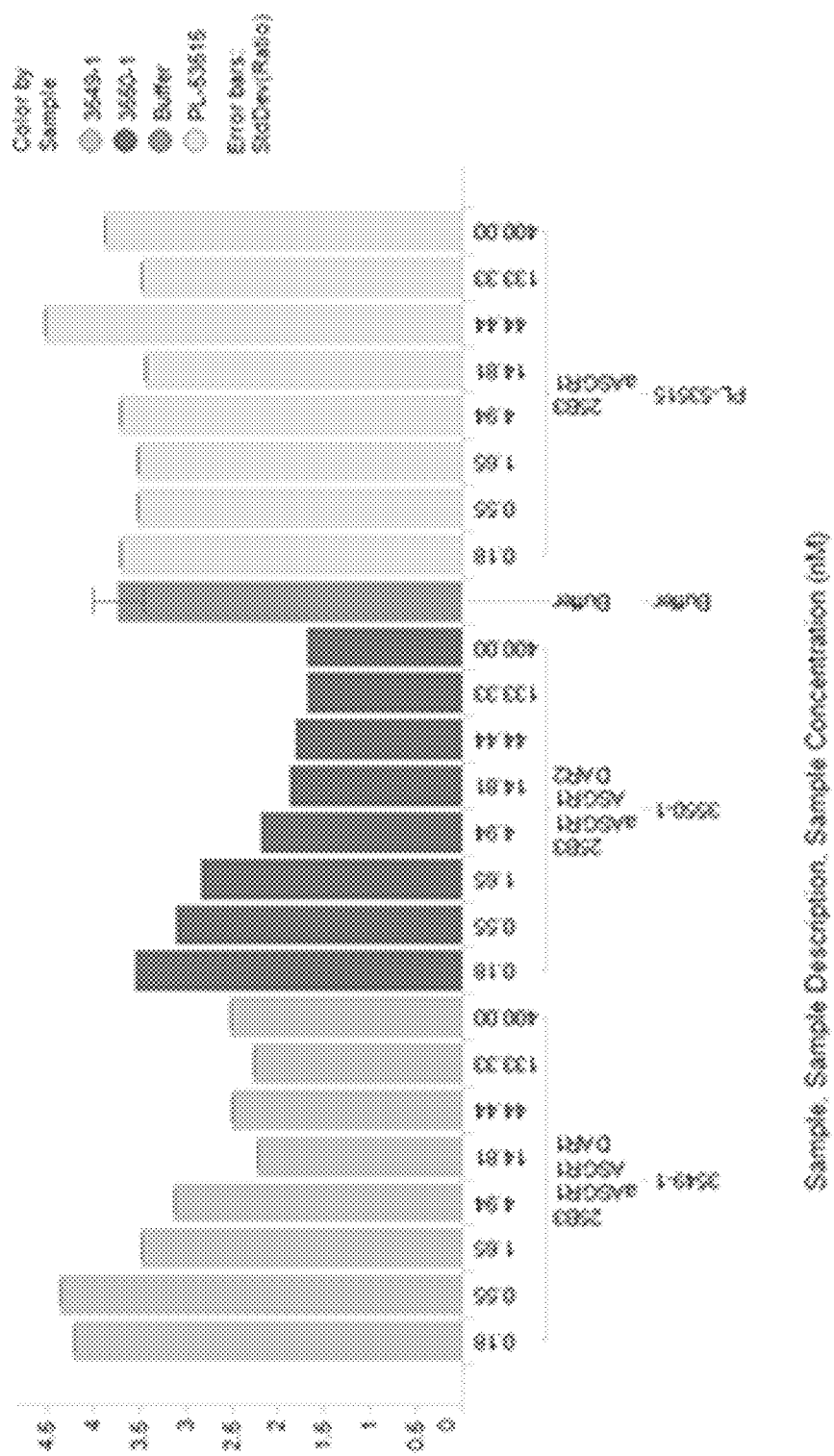
FIG. 8 is a bar graph showing a dose-dependent knockdown of ASGR1 mRNA in human primary hepatocytes observed with the 3549 (RNA-Ab ratio of 1) and 3550 (RNA-Ab ratio of 2) anti-ASGR1 mAb-siRNA conjugates. The unconjugated anti-ASGR1 cys mAb (PL-53515) was used as a control.

The mAb-siRNA conjugates were evaluated for activity in a free uptake assay to determine whether the antibody could effectively deliver the siRNA to human primary hepatocytes to inhibit ASGR1 expression. Various concentrations (0.18 nM to 400 nM) of the anti-ASGR1 mAb conjugated to 1 or 2 ASGR1 siRNA molecules (compounds 3549 and 3550, respectively) were incubated with human primary hepatocytes for four days. RNA was isolated from the cells and processed for droplet digital PCR analysis to assess ASGR1 mRNA levels as described in Example 8. The results of the in vitro assay are shown in FIG. 8. The anti-ASGR1 mAb conjugated to 1 or 2 ASGR1 siRNA molecules demonstrated 40-60% knockdown of ASGR1 mRNA. The unconjugated anti-ASGR1 cys mAb (PL-53515) was used as a control.

Next, the anti-ASGR1 mAb-siRNA conjugates were tested for in vivo efficacy. Nine-week old C57B1/6 wild-type mice were injected subcutaneously or intravenously with compound 3550 (30 mg/kg or 60 mg/kg) or a GalNAc-conjugated siRNA control. The GalNAc-conjugated siRNA control had a sense strand having a sequence of SEQ ID NO: 4698 and an antisense strand having a sequence of SEQ ID NO: 4699 and was conjugated to a triantennary GalNAc moiety at the 3' end of the sense strand. Serum and livers were collected from the animals at days 2, 4, 8, and 15 following compound administration. Total RNA isolated from the livers of the animals was processed for qPCR analysis to assess ASGR1 mRNA levels. ASGR1 protein expression in the liver was measured by ELISA. Serum levels of alkaline phosphatase (ALP) were measured by a clinical analyzer (AU400 Chemistry Analyzer, Olympus).

Figure 9A:
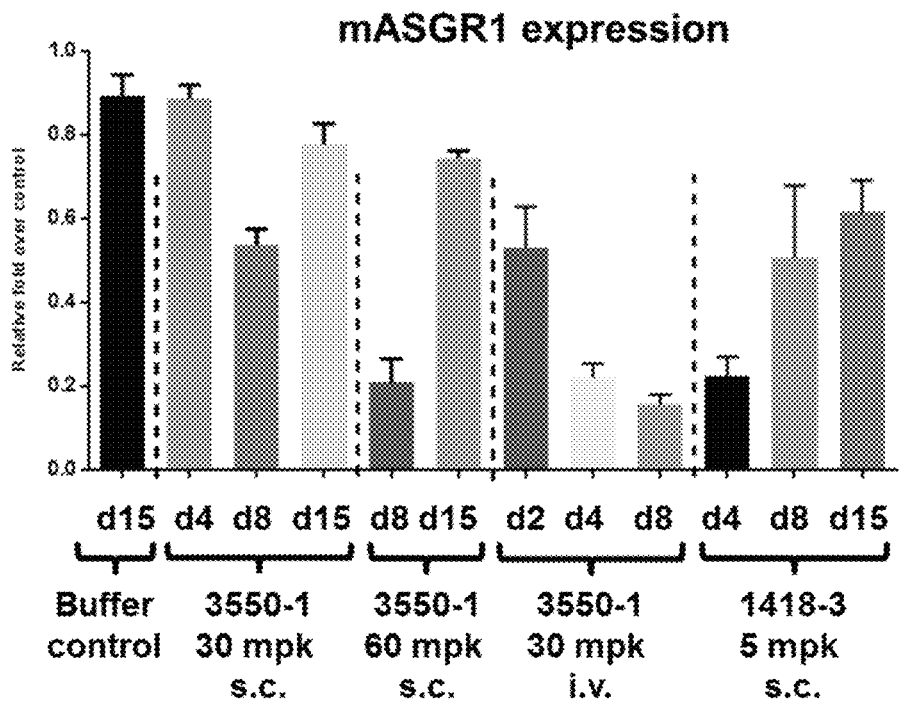
FIG. 9A is a bar graph showing the ASGR1 mRNA level in livers from wild-type mice in all dosing groups measured at the indicated time points (days 2, 4, 8, and 15). The same siRNA conjugated to a GalNAc moiety (compound 1418) was used as a positive control. The amount of siRNA in 5 mpk of 1418 is equivalent to that in 30 mpk of the 3550 compound, which has 2 siRNAs/mAb.
Figure 9B:
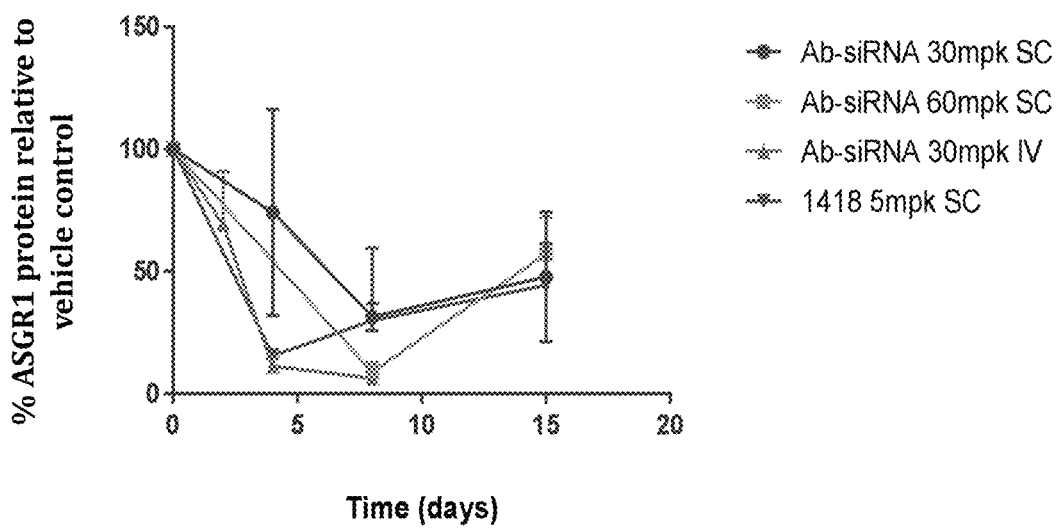
FIG. 9B is a line graph depicting ASGR1 protein expression in livers from wild-type mice in all dosing groups measured at the indicated time points (days 2, 4, 8, and 15). The same siRNA conjugated to a GalNAc moiety (compound 1418) was used as a positive control. The amount of siRNA in 5 mpk of 1418 is equivalent to that in 30 mpk of the 3550 compound, which has 2 siRNAs/mAb.
Figure 10:
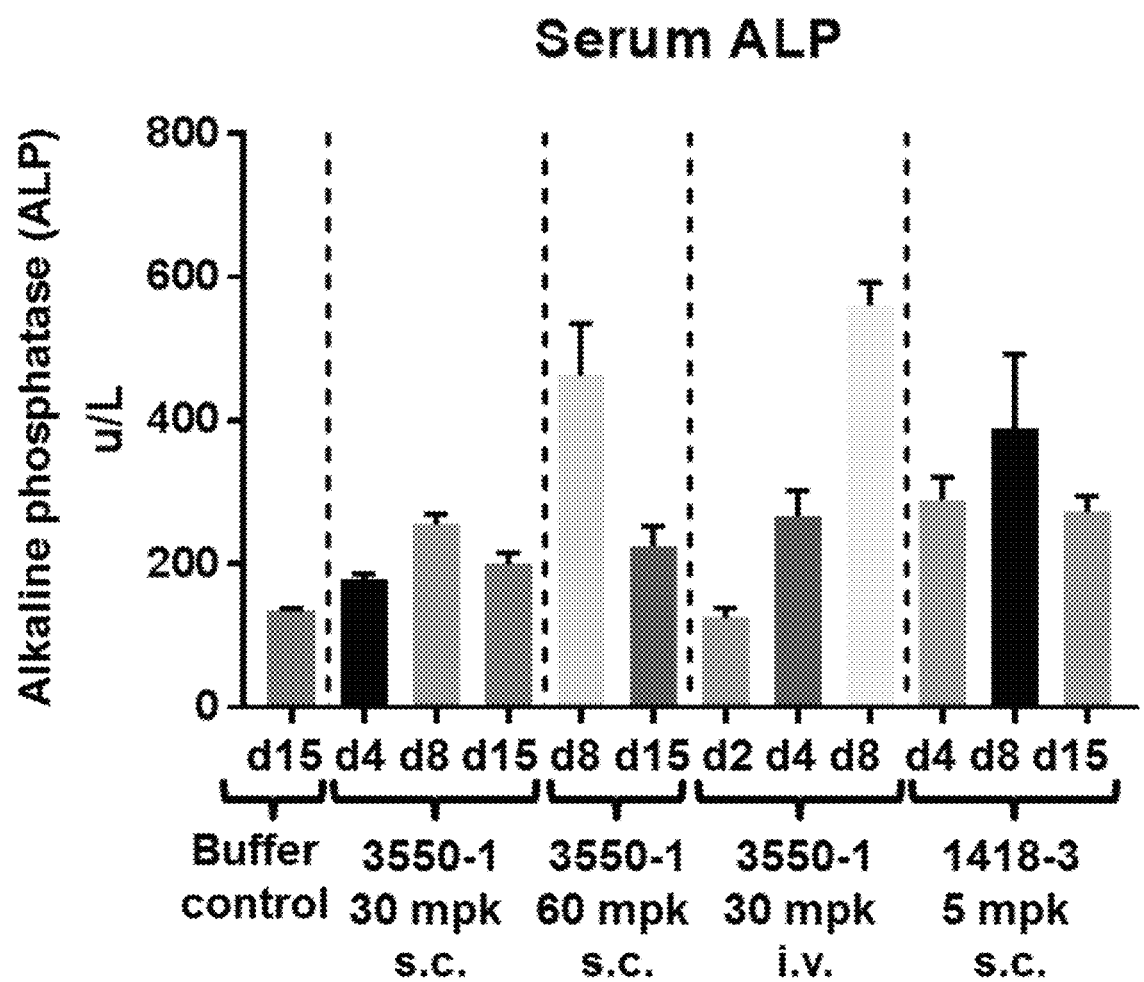
FIG. 10 is a bar graph showing serum alkaline phosphatase (ALP) from wild-type mice in all dosing groups measured at the indicated time points (days 2, 4, 8, and 15). The same siRNA conjugated to a GalNAc moiety (compound 1418) was used as a positive control. The amount of siRNA in 5 mpk of 1418 is equivalent to that in 30 mpk of the 3550 compound, which has 2 siRNAs/mAb.

The mAb-siRNA conjugate 3550 effectively delivered siRNA to its mRNA target in vivo. The highest knockdown level (~80%) resulted from 30 mpk i.v. administration of 3550 in wild-type mice measured on day 8 (FIG. 9A). The ASGR1 protein expression in liver was also measured, and >80% reduction in ASGR1 protein was achieved in the 30 mpk i.v. group, consistent with the level of mRNA knockdown (FIG. 9B). Nadir of protein knockdown was day 8 for the anti-ASGR1 mAb-siRNA conjugate, dosed either i.v. or s.c., and day 4 for the GalNAc-siRNA conjugate. The mAb-siRNA conjugate 3550 resulted in 2-4 fold increase in ALP on day 8, corresponding to decreased ASGR1 mRNA level and protein expression (FIG. 10). The anti-ASGR1 antibody alone did not induce any increase in ALP even at 100 mg/kg (data not shown).

Taken together, the results of these experiments demonstrate that siRNA duplexes can be effectively delivered to the liver using an anti-ASGR1 antibody in lieu of a GalNAc moiety. The mAb-siRNA conjugates exhibited comparable efficacy to a GalNAc-siRNA conjugate in terms of inhibition of liver ASGR1 expression and elevation of serum ALP levels, a biomarker of target inhibition.

All publications, patents, and patent applications discussed and cited herein are hereby incorporated by reference in their entireties. It is understood that the disclosed invention is not limited to the particular methodology, protocols and materials described as these can vary. It is also understood that the terminology used herein is for the purposes of describing particular embodiments only and is not intended to limit the scope of the appended claims.

Those skilled in the art will recognize, or be able to ascertain using no more than routine experimentation, many equivalents to the specific embodiments of the invention described herein. Such equivalents are intended to be encompassed by the following claims.

SEQUENCE LISTING (4699 sequences)

SEQ ID NO: 1 - DNA, 1519 bp, Homo sapiens
cccaaacggtgcacggaagagtgaggtgactggcatgtgtgggggcaacacgattctcctccctggggagcagagcagaggcaacccatcccccactcccacccccacactcccctaagttccaatccatttccacctctgtttactgtccaaagtcccgggcactggagatgccacgtttggcgtgcttggacacacagacacgcagacacagagacaccggggcccagggccctcctatggaccctgcccgctcccctcccattgtccacggctgtccgcccacccccattctccaagcttcagccccctccttagttcggcatctgcacagcactgaagaacctgggaatcagaccctgagaccctgagcaatcccaggtccagcgccagccctatcatgaccaaggagtatcaagaccttcagcatctggacaatgaggagagtgaccaccatcagctcagaaaagggccacctcctccccagcccctcctgcagcgtctctgctccggacctcgcctcctcctgctctccctgggcctcagcctcctgctgcttgtggttgtctgtgtgatcggatcccaaaactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaaaacgggccctggaagtgggtggacgggacggactacgagacgggcttcaagaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaatttatttcttcaatgcctcgacctgccgcaggggtccgggattgggaatccgcccatctgggggcctcttctgctttctcgggaattttcatctaggattttaagggaaggggaaggatagggtgatgttccgaaggtgaggagcttgaaacccgtggcgctttctgcagtttgcaggttatcattgtgaactttttttttttaagagtaaaaagaaatatacctaaaaaaaaaaaaaaaaaa

SEQ ID NO: 2 - DNA, 1402 bp, Homo sapiens
cccaaacggtgcacggaagagtgaggtgactggcatgtgtgggggcaacacgattctcctccctggggagcagagcagaggcaacccatcccccactcccacccccacactcccctaagttccaatccatttccacctctgtttactgtccaaagtcccgggcactggagatgccacgtttggcgtgcttggacacacagacacgcagacacagagacaccggggcccagggccctcctatggaccctgcccgctcccctcccattgtccacggctgtccgcccacccccattctccaagcttcagccccctccttagttcggcatctgcacagcactgaagaacctgggaatcagaccctgagaccctgagcaatcccaggtccagcgccagccctatcatgaccaaggagtatcaagaccttcagcatctggacaatgaggagagtgaccaccatcagctcagaaaagactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaaaacgggccctggaagtgggtggacgggacggactacgagacgggcttcaagaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaatttatttcttcaatgcctcgacctgccgcaggggtccgggattgggaatccgcccatctgggggcctcttctgctttctcgggaattttcatctaggattttaagggaaggggaaggatagggtgatgttccgaaggtgaggagcttgaaacccgtggcgctttctgcagtttgcaggttatcattgtgaactttttttttttaagagtaaaaagaaatatacctaaaaaaaaaaaaaaaaaa

SEQ ID NO: 3 - protein, 214 aa, Artificial Sequence
  Synthetic polypeptide
DIQMTQSPSSLSASVGDRVTIACRASQNIISYLNWYQQKPGKAPKFLIYTASSLQSGVPSRFSGSGSGTDFTLTISSLQPEDFAIYYCQQTYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4 - protein, 448 aa, Artificial Sequence
  Synthetic polypeptide
QVQLVESGGGVVQPGRSLRLSCAASGFTFSSFGMHWVRQAPGKGLEWVAIIWHDGSNKYYADSVKGRFTISRDNSKNTLYLQMSSLRAEDTAVYYCARDLSMGGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5 - RNA, 21 nt, Artificial Sequence
  Synthetic polynucleotide
uguccagcaccacauaggcuu

SEQ ID NO: 6 - RNA, 21 nt, Artificial Sequence
  Synthetic polynucleotide
guccagcaccacauaggccuu

SEQ ID NO: 7 - RNA, 21 nt, Artificial Sequence
  Synthetic polynucleotide
cacccccacacuccccuaauu

SEQ ID NO: 8 - RNA, 21 nt, Artificial Sequence
  Synthetic polynucleotide
uccagcaccacauaggcccuu

SEQ ID NO: 9 - RNA, 21 nt, Artificial Sequence
  Synthetic polynucleotide
ccagcaccacauaggcccuuu

SEQ ID NO: 10 - RNA, 21 nt, Artificial Sequence
  Synthetic polynucleotide
cagcaccacauaggcccuguu

SEQ ID NO: 11 - RNA, 21 nt, Artificial Sequence
  Synthetic polynucleotide
agcaccacauaggcccuguuu

SEQ ID NO: 12 - RNA, 21 nt, Artificial Sequence
  Synthetic polynucleotide
gcaccacauaggcccuguguu

SEQ ID NO: 13 - RNA, 21 nt, Artificial Sequence
  Synthetic polynucleotide
caccacauaggcccugugauu

SEQ ID NO: 14 - RNA, 21 nt, Artificial Sequence
  Synthetic polynucleotide
accacauaggcccugugaauu

SEQ ID NO: 15 - RNA, 21 nt, Artificial Sequence
  Synthetic polynucleotide
ccacauaggcccugugaacuu

SEQ ID NO: 16 - RNA, 21 nt, Artificial Sequence
  Synthetic polynucleotide
cacauaggcccugugaacauu

SEQ ID NO: 17 - RNA, 21 nt, Artificial Sequence
  Synthetic polynucleotide
acauaggcccugugaacacuu

SEQ ID NO: 18 - RNA, 21 nt, Artificial Sequence
  Synthetic polynucleotide
acccccacacuccccuaaguu

SEQ ID NO: 19 - RNA, 21 nt, Artificial Sequence
  Synthetic polynucleotide
cauaggcccugugaacaccuu

SEQ ID NO: 20 - RNA, 21 nt, Artificial Sequence
  Synthetic polynucleotide
auaggcccugugaacaccuuu

SEQ ID NO: 21 - RNA, 21 nt, Artificial Sequence
  Synthetic polynucleotide
uaggcccugugaacaccuguu

SEQ ID NO: 22 - RNA, 21 nt, Artificial Sequence
  Synthetic polynucleotide
aggcccugugaacaccugguu

SEQ ID NO: 23 - RNA, 21 nt, Artificial Sequence
  Synthetic polynucleotide
ggcccugugaacaccuggauu

SEQ ID NO: 24 - RNA, 21 nt, Artificial Sequence
  Synthetic polynucleotide
gcccugugaacaccuggauuu

SEQ ID NO: 25 - RNA, 21 nt, Artificial Sequence
  Synthetic polynucleotide
cccugugaacaccuggauguu

SEQ ID NO: 26 - RNA, 21 nt, Artificial Sequence
  Synthetic polynucleotide
ccugugaacaccuggaugguu

SEQ ID NO: 27 - RNA, 21 nt, Artificial Sequence
  Synthetic polynucleotide
cugugaacaccuggauggguu

SEQ ID NO: 28 - RNA, 21 nt, Artificial Sequence
  Synthetic polynucleotide
ugugaacaccuggaugggcuu

SEQ ID NO: 29 - RNA, 21 nt, Artificial Sequence
  Synthetic polynucleotide
cccccacacuccccuaaguuu

SEQ ID NO: 30 - RNA, 21 nt, Artificial Sequence
  Synthetic polynucleotide
gugaacaccuggaugggccuu

SEQ ID NO: 31 - RNA, 21 nt, Artificial Sequence
  Synthetic polynucleotide
ugaacaccuggaugggccuuu

SEQ ID NO: 32 - RNA, 21 nt, Artificial Sequence
  Synthetic polynucleotide
gaacaccuggaugggccucuu

SEQ ID NO: 33 - RNA, 21 nt, Artificial Sequence
  Synthetic polynucleotide
aacaccuggaugggccuccuu

SEQ ID NO: 34 - RNA, 21 nt, Artificial Sequence
  Synthetic polynucleotide
acaccuggaugggccuccauu

SEQ ID NO: 35 - RNA, 21 nt, Artificial Sequence
  Synthetic polynucleotide
caccuggaugggccuccacuu

SEQ ID NO: 36 - RNA, 21 nt, Artificial Sequence
  Synthetic polynucleotide
ugcacggaagagugagguguu

SEQ ID NO: 37 - RNA, 21 nt, Artificial Sequence
  Synthetic polynucleotide
accuggaugggccuccacguu

SEQ ID NO: 38 - RNA, 21 nt, Artificial Sequence
  Synthetic polynucleotide
ccuggaugggccuccacgauu

SEQ ID NO: 39 - RNA, 21 nt, Artificial Sequence
  Synthetic polynucleotide
cuggaugggccuccacgacuu

SEQ ID NO: 40 - RNA, 21 nt, Artificial Sequence
  Synthetic polynucleotide
uggaugggccuccacgaccuu

SEQ ID NO: 41 - RNA, 21 nt, Artificial Sequence
  Synthetic polynucleotide
ccccacacuccccuaaguuuu

SEQ ID NO: 42 - RNA, 21 nt, Artificial Sequence
  Synthetic polynucleotide
ggaugggccuccacgaccauu

SEQ ID NO: 43 - RNA, 21 nt, Artificial Sequence
  Synthetic polynucleotide
gaugggccuccacgaccaauu

SEQ ID NO: 44 - RNA, 21 nt, Artificial Sequence
  Synthetic polynucleotide
augggccuccacgaccaaauu

SEQ ID NO: 45 - RNA, 21 nt, Artificial Sequence
  Synthetic polynucleotide
ugggccuccacgaccaaaauu

SEQ ID NO: 46 - RNA, 21 nt, Artificial Sequence
  Synthetic polynucleotide
gggccuccacgaccaaaacuu

SEQ ID NO: 47 - RNA, 21 nt, Artificial Sequence
  Synthetic polynucleotide
ggccuccacgaccaaaacguu

SEQ ID NO: 48 - RNA, 21 nt, Artificial Sequence
  Synthetic polynucleotide
gccuccacgaccaaaacgguu

SEQ ID NO: 49 - RNA, 21 nt, Artificial Sequence
  Synthetic polynucleotide
ccuccacgaccaaaacggguu

SEQ ID NO: 50 - RNA, 21 nt, Artificial Sequence
  Synthetic polynucleotide
cuccacgaccaaaacgggcuu

SEQ ID NO: 51 - RNA, 21 nt, Artificial Sequence
  Synthetic polynucleotide
uccacgaccaaaacgggccuu

SEQ ID NO: 52 - RNA, 21 nt, Artificial Sequence
  Synthetic polynucleotide
cccacacuccccuaaguucuu

SEQ ID NO: 53 - RNA, 21 nt, Artificial Sequence
  Synthetic polynucleotide
ccacgaccaaaacgggcccuu

SEQ ID NO: 54 - RNA, 21 nt, Artificial Sequence
  Synthetic polynucleotide
cacgaccaaaacgggcccuuu

SEQ ID NO: 55 - RNA, 21 nt, Artificial Sequence
  Synthetic polynucleotide
acgaccaaaacgggcccuguu

SEQ ID NO: 56 - RNA, 21 nt, Artificial Sequence
  Synthetic polynucleotide
cgaccaaaacgggcccugguu

SEQ ID NO: 57 - RNA, 21 nt, Artificial Sequence
  Synthetic polynucleotide
gaccaaaacgggcccuggauu

SEQ ID NO: 58 - RNA, 21 nt, Artificial Sequence
  Synthetic polynucleotide
accaaaacgggcccuggaauu

SEQ ID NO: 59 - RNA, 21 nt, Artificial Sequence
  Synthetic polynucleotide
ccaaaacgggcccuggaaguu

SEQ ID NO: 60 - RNA, 21 nt, Artificial Sequence
  Synthetic polynucleotide
caaaacgggcccuggaaguuu

SEQ ID NO: 61 - RNA, 21 nt, Artificial Sequence
  Synthetic polynucleotide
aaaacgggcccuggaaguguu

SEQ ID NO: 62 - RNA, 21 nt, Artificial Sequence
  Synthetic polynucleotide
aaacgggcccuggaagugguu

SEQ ID NO: 63 - RNA, 21 nt, Artificial Sequence
  Synthetic polynucleotide
ccacacuccccuaaguuccuu

SEQ ID NO: 64 - RNA, 21 nt, Artificial Sequence
  Synthetic polynucleotide
aacgggcccuggaaguggguu

SEQ ID NO: 65 - RNA, 21 nt, Artificial Sequence
  Synthetic polynucleotide
acgggcccuggaaguggguuu

SEQ ID NO: 66 - RNA, 21 nt, Artificial Sequence
  Synthetic polynucleotide
cgggcccuggaaguggguguu

SEQ ID NO: 67 - RNA, 21 nt, Artificial Sequence
  Synthetic polynucleotide
gggcccuggaagugggugguu

SEQ ID NO: 68 - RNA, 21 nt, Artificial Sequence
  Synthetic polynucleotide
ggcccuggaaguggguggauu

SEQ ID NO: 69 - RNA, 21 nt, Artificial Sequence
  Synthetic polynucleotide
gcccuggaaguggguggacuu

SEQ ID NO: 70 - RNA, 21 nt, Artificial Sequence
  Synthetic polynucleotide
cccuggaaguggguggacguu

SEQ ID NO: 71 - RNA, 21 nt, Artificial Sequence
  Synthetic polynucleotide
ccuggaaguggguggacgguu

SEQ ID NO: 72 - RNA, 21 nt, Artificial Sequence
  Synthetic polynucleotide
cuggaaguggguggacggguu

SEQ ID NO: 73 - RNA, 21 nt, Artificial Sequence
  Synthetic polynucleotide
uggaaguggguggacgggauu

SEQ ID NO: 74 - RNA, 21 nt, Artificial Sequence
  Synthetic polynucleotide
cacacuccccuaaguuccauu

SEQ ID NO: 75 - RNA, 21 nt, Artificial Sequence
  Synthetic polynucleotide
ggaaguggguggacgggacuu

SEQ ID NO: 76 - RNA, 21 nt, Artificial Sequence
  Synthetic polynucleotide
gaaguggguggacgggacguu

SEQ ID NO: 77 - RNA, 21 nt, Artificial Sequence
  Synthetic polynucleotide
aaguggguggacgggacgguu

SEQ ID NO: 78 - RNA, 21 nt, Artificial Sequence
  Synthetic polynucleotide
aguggguggacgggacggauu

SEQ ID NO: 79 - RNA, 21 nt, Artificial Sequence
  Synthetic polynucleotide
guggguggacgggacggacuu

SEQ ID NO: 80 - RNA, 21 nt, Artificial Sequence
  Synthetic polynucleotide
uggguggacgggacggacuuu

SEQ ID NO: 81 - RNA, 21 nt, Artificial Sequence
  Synthetic polynucleotide
ggguggacgggacggacuauu

SEQ ID NO: 82 - RNA, 21 nt, Artificial Sequence
  Synthetic polynucleotide
gguggacgggacggacuacuu

SEQ ID NO: 83 - RNA, 21 nt, Artificial Sequence
  Synthetic polynucleotide
guggacgggacggacuacguu

SEQ ID NO: 84 - RNA, 21 nt, Artificial Sequence
  Synthetic polynucleotide
uggacgggacggacuacgauu

SEQ ID NO: 85 - RNA, 21 nt, Artificial Sequence
  Synthetic polynucleotide
acacuccccuaaguuccaauu

SEQ ID NO: 86 - RNA, 21 nt, Artificial Sequence
  Synthetic polynucleotide
ggacgggacggacuacgaguu

SEQ ID NO: 87 - RNA, 21 nt, Artificial Sequence
  Synthetic polynucleotide
gacgggacggacuacgagauu

SEQ ID NO: 88 - RNA, 21 nt, Artificial Sequence
  Synthetic polynucleotide
acgggacggacuacgagacuu

SEQ ID NO: 89 - RNA, 21 nt, Artificial Sequence
  Synthetic polynucleotide
cgggacggacuacgagacguu

SEQ ID NO: 90 - RNA, 21 nt, Artificial Sequence
  Synthetic polynucleotide
gggacggacuacgagacgguu

SEQ ID NO: 91 - RNA, 21 nt, Artificial Sequence
  Synthetic polynucleotide
ggacggacuacgagacggguu

SEQ ID NO: 92 - RNA, 21 nt, Artificial Sequence
  Synthetic polynucleotide
gacggacuacgagacgggcuu

SEQ ID NO: 93 - RNA, 21 nt, Artificial Sequence
  Synthetic polynucleotide
acggacuacgagacgggcuuu

SEQ ID NO: 94 - RNA, 21 nt, Artificial Sequence
  Synthetic polynucleotide
cggacuacgagacgggcuuuu

SEQ ID NO: 95 - RNA, 21 nt, Artificial Sequence
  Synthetic polynucleotide
ggacuacgagacgggcuucuu

SEQ ID NO: 96 - RNA, 21 nt, Artificial Sequence
  Synthetic polynucleotide
cacuccccuaaguuccaauuu

SEQ ID NO: 97 - RNA, 21 nt, Artificial Sequence
  Synthetic polynucleotide
gacuacgagacgggcuucauu

SEQ ID NO: 98 - RNA, 21 nt, Artificial Sequence
  Synthetic polynucleotide
acuacgagacgggcuucaauu

SEQ ID NO: 99 - RNA, 21 nt, Artificial Sequence
  Synthetic polynucleotide
cuacgagacgggcuucaaguu

SEQ ID NO: 100 - RNA, 21 nt, Artificial Sequence
  Synthetic polynucleotide
uacgagacgggcuucaagauu

SEQ ID NO: 101 - RNA, 21 nt, Artificial Sequence
  Synthetic polynucleotide
acgagacgggcuucaagaauu

SEQ ID NO: 102 - RNA, 21 nt, Artificial Sequence
  Synthetic polynucleotide
cgagacgggcuucaagaacuu

SEQ ID NO: 103 - RNA, 21 nt, Artificial Sequence
  Synthetic polynucleotide
gagacgggcuucaagaacuuu

SEQ ID NO: 104 - RNA, 21 nt, Artificial Sequence
  Synthetic polynucleotide
agacgggcuucaagaacuguu

SEQ ID NO: 105 - RNA, 21 nt, Artificial Sequence
  Synthetic polynucleotide
gacgggcuucaagaacugguu

SEQ ID NO: 106 - RNA, 21 nt, Artificial Sequence
  Synthetic polynucleotide
acgggcuucaagaacuggauu

SEQ ID NO: 107 - RNA, 21 nt, Artificial Sequence
  Synthetic polynucleotide
acuccccuaaguuccaaucuu

SEQ ID NO: 108 - RNA, 21 nt, Artificial Sequence
  Synthetic polynucleotide
cgggcuucaagaacuggaguu

SEQ ID NO: 109 - RNA, 21 nt, Artificial Sequence
  Synthetic polynucleotide
gggcuucaagaacuggagguu

SEQ ID NO: 110 - RNA, 21 nt, Artificial Sequence
  Synthetic polynucleotide
ggcuucaagaacuggaggcuu

SEQ ID NO: 111 - RNA, 21 nt, Artificial Sequence
  Synthetic polynucleotide
gcuucaagaacuggaggccuu

SEQ ID NO: 112 - RNA, 21 nt, Artificial Sequence
  Synthetic polynucleotide
cuucaagaacuggaggccguu

SEQ ID NO: 113 - RNA, 21 nt, Artificial Sequence
  Synthetic polynucleotide
uucaagaacuggaggccgguu

SEQ ID NO: 114 - RNA, 21 nt, Artificial Sequence
  Synthetic polynucleotide
ucaagaacuggaggccggauu

SEQ ID NO: 115 - RNA, 21 nt, Artificial Sequence
  Synthetic polynucleotide
caagaacuggaggccggaguu

SEQ ID NO: 116 - RNA, 21 nt, Artificial Sequence
  Synthetic polynucleotide
aagaacuggaggccggagcuu

SEQ ID NO: 117 - RNA, 21 nt, Artificial Sequence
  Synthetic polynucleotide
agaacuggaggccggagcauu

SEQ ID NO: 118 - RNA, 21 nt, Artificial Sequence
  Synthetic polynucleotide
cuccccuaaguuccaauccuu

SEQ ID NO: 119 - RNA, 21 nt, Artificial Sequence
  Synthetic polynucleotide
gaacuggaggccggagcaguu

SEQ ID NO: 120 - RNA, 21 nt, Artificial Sequence
  Synthetic polynucleotide
aacuggaggccggagcagcuu

SEQ ID NO: 121 - RNA, 21 nt, Artificial Sequence
  Synthetic polynucleotide
acuggaggccggagcagccuu

SEQ ID NO: 122 - RNA, 21 nt, Artificial Sequence
  Synthetic polynucleotide
cuggaggccggagcagccguu

SEQ ID NO: 123 - RNA, 21 nt, Artificial Sequence
  Synthetic polynucleotide
uggaggccggagcagccgguu

SEQ ID NO: 124 - RNA, 21 nt, Artificial Sequence
  Synthetic polynucleotide
ggaggccggagcagccggauu

SEQ ID NO: 125 - RNA, 21 nt, Artificial Sequence
  Synthetic polynucleotide
gaggccggagcagccggacuu

SEQ ID NO: 126 - RNA, 21 nt, Artificial Sequence
  Synthetic polynucleotide
aggccggagcagccggacguu

SEQ ID NO: 127 - RNA, 21 nt, Artificial Sequence
  Synthetic polynucleotide
ggccggagcagccggacgauu

SEQ ID NO: 128 - RNA, 21 nt, Artificial Sequence
  Synthetic polynucleotide
gccggagcagccggacgacuu

SEQ ID NO: 129 - RNA, 21 nt, Artificial Sequence
  Synthetic polynucleotide
uccccuaaguuccaauccauu

SEQ ID NO: 130 - RNA, 21 nt, Artificial Sequence
  Synthetic polynucleotide
ccggagcagccggacgacuuu

SEQ ID NO: 131 - RNA, 21 nt, Artificial Sequence
  Synthetic polynucleotide
cggagcagccggacgacuguu

SEQ ID NO: 132 - RNA, 21 nt, Artificial Sequence
  Synthetic polynucleotide
ggagcagccggacgacugguu

SEQ ID NO: 133 - RNA, 21 nt, Artificial Sequence
  Synthetic polynucleotide
gagcagccggacgacugguuu

SEQ ID NO: 134 - RNA, 21 nt, Artificial Sequence
  Synthetic polynucleotide
agcagccggacgacugguauu

SEQ ID NO: 135 - RNA, 21 nt, Artificial Sequence
  Synthetic polynucleotide
gcagccggacgacugguacuu

SEQ ID NO: 136 - RNA, 21 nt, Artificial Sequence
  Synthetic polynucleotide
cagccggacgacugguacguu

SEQ ID NO: 137 - RNA, 21 nt, Artificial Sequence
  Synthetic polynucleotide
agccggacgacugguacgguu

SEQ ID NO: 138 - RNA, 21 nt, Artificial Sequence
  Synthetic polynucleotide
gccggacgacugguacggcuu

SEQ ID NO: 139 - RNA, 21 nt, Artificial Sequence
  Synthetic polynucleotide
ccggacgacugguacggccuu

SEQ ID NO: 140 - RNA, 21 nt, Artificial Sequence
  Synthetic polynucleotide
ccccuaaguuccaauccauuu

SEQ ID NO: 141 - RNA, 21 nt, Artificial Sequence
  Synthetic polynucleotide
cggacgacugguacggccauu

SEQ ID NO: 142 - RNA, 21 nt, Artificial Sequence
  Synthetic polynucleotide
ggacgacugguacggccacuu

SEQ ID NO: 143 - RNA, 21 nt, Artificial Sequence
  Synthetic polynucleotide
gacgacugguacggccacguu

SEQ ID NO: 144 - RNA, 21 nt, Artificial Sequence
  Synthetic polynucleotide
acgacugguacggccacgguu

SEQ ID NO: 145 - RNA, 21 nt, Artificial Sequence
  Synthetic polynucleotide
cgacugguacggccacggguu

SEQ ID NO: 146 - RNA, 21 nt, Artificial Sequence
  Synthetic polynucleotide
gacugguacggccacgggcuu

SEQ ID NO: 147 - RNA, 21 nt, Artificial Sequence
  Synthetic polynucleotide
acugguacggccacgggcuuu

SEQ ID NO: 148 - RNA, 21 nt, Artificial Sequence
  Synthetic polynucleotide
gcacggaagagugaggugauu

SEQ ID NO: 149 - RNA, 21 nt, Artificial Sequence
  Synthetic polynucleotide
cugguacggccacgggcucuu

SEQ ID NO: 150 - RNA, 21 nt, Artificial Sequence
  Synthetic polynucleotide
ugguacggccacgggcucguu

SEQ ID NO: 151 - RNA, 21 nt, Artificial Sequence
  Synthetic polynucleotide
gguacggccacgggcucgguu

SEQ ID NO: 152 - RNA, 21 nt, Artificial Sequence
  Synthetic polynucleotide
cccuaaguuccaauccauuuu

SEQ ID NO: 153 - RNA, 21 nt, Artificial Sequence
  Synthetic polynucleotide
guacggccacgggcucggauu

SEQ ID NO: 154 - RNA, 21 nt, Artificial Sequence
  Synthetic polynucleotide
uacggccacgggcucggaguu

SEQ ID NO: 155 - RNA, 21 nt, Artificial Sequence
  Synthetic polynucleotide
acggccacgggcucggagguu

SEQ ID NO: 156 - RNA, 21 nt, Artificial Sequence
  Synthetic polynucleotide
cggccacgggcucggaggauu

SEQ ID NO: 157 - RNA, 21 nt, Artificial Sequence
  Synthetic polynucleotide
ggccacgggcucggaggaguu

SEQ ID NO: 158 - RNA, 21 nt, Artificial Sequence
  Synthetic polynucleotide
gccacgggcucggaggagguu

SEQ ID NO: 159 - RNA, 21 nt, Artificial Sequence
  Synthetic polynucleotide
ccacgggcucggaggaggcuu

SEQ ID NO: 160 - RNA, 21 nt, Artificial Sequence
  Synthetic polynucleotide
cacgggcucggaggaggcguu

SEQ ID NO: 161 - RNA, 21 nt, Artificial Sequence
  Synthetic polynucleotide
acgggcucggaggaggcgauu

SEQ ID NO: 162 - RNA, 21 nt, Artificial Sequence
  Synthetic polynucleotide
cgggcucggaggaggcgaguu

SEQ ID NO: 163 - RNA, 21 nt, Artificial Sequence
  Synthetic polynucleotide
ccuaaguuccaauccauuuuu

SEQ ID NO: 164 - RNA, 21 nt, Artificial Sequence
  Synthetic polynucleotide
gggcucggaggaggcgagguu

SEQ ID NO: 165 - RNA, 21 nt, Artificial Sequence
  Synthetic polynucleotide
ggcucggaggaggcgaggauu

SEQ ID NO: 166 - RNA, 21 nt, Artificial Sequence
  Synthetic polynucleotide
gcucggaggaggcgaggacuu

SEQ ID NO: 167 - RNA, 21 nt, Artificial Sequence
  Synthetic polynucleotide
cucggaggaggcgaggacuuu

SEQ ID NO: 168 - RNA, 21 nt, Artificial Sequence
  Synthetic polynucleotide
ucggaggaggcgaggacuguu

SEQ ID NO: 169 - RNA, 21 nt, Artificial Sequence
  Synthetic polynucleotide
cggaggaggcgaggacuguuu

SEQ ID NO: 170 - RNA, 21 nt, Artificial Sequence
  Synthetic polynucleotide
ggaggaggcgaggacuguguu

SEQ ID NO: 171 - RNA, 21 nt, Artificial Sequence
  Synthetic polynucleotide
gaggaggcgaggacugugcuu

SEQ ID NO: 172 - RNA, 21 nt, Artificial Sequence
  Synthetic polynucleotide
aggaggcgaggacugugccuu

SEQ ID NO: 173 - RNA, 21 nt, Artificial Sequence
  Synthetic polynucleotide
ggaggcgaggacugugcccuu

SEQ ID NO: 174 - RNA, 21 nt, Artificial Sequence
  Synthetic polynucleotide
cuaaguuccaauccauuucuu

SEQ ID NO: 175 - RNA, 21 nt, Artificial Sequence
  Synthetic polynucleotide
gaggcgaggacugugcccauu

SEQ ID NO: 176 - RNA, 21 nt, Artificial Sequence
  Synthetic polynucleotide
aggcgaggacugugcccacuu

SEQ ID NO: 177 - RNA, 21 nt, Artificial Sequence
  Synthetic polynucleotide
ggcgaggacugugcccacuuu

SEQ ID NO: 178 - RNA, 21 nt, Artificial Sequence
  Synthetic polynucleotide
gcgaggacugugcccacuuuu

SEQ ID NO: 179 - RNA, 21 nt, Artificial Sequence
  Synthetic polynucleotide
cgaggacugugcccacuucuu

SEQ ID NO: 180 - RNA, 21 nt, Artificial Sequence
  Synthetic polynucleotide
gaggacugugcccacuucauu

SEQ ID NO: 181 - RNA, 21 nt, Artificial Sequence
  Synthetic polynucleotide
aggacugugcccacuucacuu

SEQ ID NO: 182 - RNA, 21 nt, Artificial Sequence
  Synthetic polynucleotide
ggacugugcccacuucaccuu

SEQ ID NO: 183 - RNA, 21 nt, Artificial Sequence
  Synthetic polynucleotide
gacugugcccacuucaccguu

SEQ ID NO: 184 - RNA, 21 nt, Artificial Sequence
  Synthetic polynucleotide
acugugcccacuucaccgauu

SEQ ID NO: 185 - RNA, 21 nt, Artificial Sequence
  Synthetic polynucleotide
uaaguuccaauccauuuccuu

SEQ ID NO: 186 - RNA, 21 nt, Artificial Sequence
  Synthetic polynucleotide
cugugcccacuucaccgacuu

SEQ ID NO: 187 - RNA, 21 nt, Artificial Sequence
  Synthetic polynucleotide
ugugcccacuucaccgacguu

SEQ ID NO: 188 - RNA, 21 nt, Artificial Sequence
  Synthetic polynucleotide
gugcccacuucaccgacgauu

SEQ ID NO: 189 - RNA, 21 nt, Artificial Sequence
  Synthetic polynucleotide
ugcccacuucaccgacgacuu

SEQ ID NO: 190 - RNA, 21 nt, Artificial Sequence
  Synthetic polynucleotide
gcccacuucaccgacgacguu

SEQ ID NO: 191 - RNA, 21 nt, Artificial Sequence
  Synthetic polynucleotide
cccacuucaccgacgacgguu

SEQ ID NO: 192 - RNA, 21 nt, Artificial Sequence
  Synthetic polynucleotide
ccacuucaccgacgacggcuu

SEQ ID NO: 193 - RNA, 21 nt, Artificial Sequence
  Synthetic polynucleotide
cacuucaccgacgacggccuu

SEQ ID NO: 194 - RNA, 21 nt, Artificial Sequence
  Synthetic polynucleotide
acuucaccgacgacggccguu

SEQ ID NO: 195 - RNA, 21 nt, Artificial Sequence
  Synthetic polynucleotide
cuucaccgacgacggccgcuu

SEQ ID NO: 196 - RNA, 21 nt, Artificial Sequence
  Synthetic polynucleotide
aaguuccaauccauuuccauu

SEQ ID NO: 197 - RNA, 21 nt, Artificial Sequence
  Synthetic polynucleotide
uucaccgacgacggccgcuuu

SEQ ID NO: 198 - RNA, 21 nt, Artificial Sequence
  Synthetic polynucleotide
ucaccgacgacggccgcuguu

SEQ ID NO: 199 - RNA, 21 nt, Artificial Sequence
  Synthetic polynucleotide
caccgacgacggccgcugguu

SEQ ID NO: 200 - RNA, 21 nt, Artificial Sequence
  Synthetic polynucleotide
accgacgacggccgcuggauu

SEQ ID NO: 201 - RNA, 21 nt, Artificial Sequence
  Synthetic polynucleotide
ccgacgacggccgcuggaauu

SEQ ID NO: 202 - RNA, 21 nt, Artificial Sequence
  Synthetic polynucleotide
cgacgacggccgcuggaacuu

SEQ ID NO: 203 - RNA, 21 nt, Artificial Sequence
  Synthetic polynucleotide
gacgacggccgcuggaacguu

SEQ ID NO: 204 - RNA, 21 nt, Artificial Sequence
  Synthetic polynucleotide
acgacggccgcuggaacgauu

SEQ ID NO: 205 - RNA, 21 nt, Artificial Sequence
  Synthetic polynucleotide
cgacggccgcuggaacgacuu

SEQ ID NO: 206 - RNA, 21 nt, Artificial Sequence
  Synthetic polynucleotide
gacggccgcuggaacgacguu

SEQ ID NO: 207 - RNA, 21 nt, Artificial Sequence
  Synthetic polynucleotide
aguuccaauccauuuccacuu

SEQ ID NO: 208 - RNA, 21 nt, Artificial Sequence
  Synthetic polynucleotide
acggccgcuggaacgacgauu

SEQ ID NO: 209 - RNA, 21 nt, Artificial Sequence
  Synthetic polynucleotide
cggccgcuggaacgacgacuu

SEQ ID NO: 210 - RNA, 21 nt, Artificial Sequence
  Synthetic polynucleotide
ggccgcuggaacgacgacguu

SEQ ID NO: 211 - RNA, 21 nt, Artificial Sequence
  Synthetic polynucleotide
gccgcuggaacgacgacguuu

SEQ ID NO: 212 - RNA, 21 nt, Artificial Sequence
  Synthetic polynucleotide
ccgcuggaacgacgacgucuu

SEQ ID NO: 213 - RNA, 21 nt, Artificial Sequence
  Synthetic polynucleotide
cgcuggaacgacgacgucuuu

SEQ ID NO: 214 - RNA, 21 nt, Artificial Sequence
  Synthetic polynucleotide
gcuggaacgacgacgucuguu

SEQ ID NO: 215 - RNA, 21 nt, Artificial Sequence
  Synthetic polynucleotide
cuggaacgacgacgucugcuu

SEQ ID NO: 216 - RNA, 21 nt, Artificial Sequence
  Synthetic polynucleotide
cccaaacggugcacggaaguu

SEQ ID NO: 217 - RNA, 21 nt, Artificial Sequence
  Synthetic polynucleotide
uggaacgacgacgucugccuu

SEQ ID NO: 218 - RNA, 21 nt, Artificial Sequence
  Synthetic polynucleotide
ggaacgacgacgucugccauu

SEQ ID NO: 219 - RNA, 21 nt, Artificial Sequence
  Synthetic polynucleotide
guuccaauccauuuccaccuu

SEQ ID NO: 220 - RNA, 21 nt, Artificial Sequence
  Synthetic polynucleotide
gaacgacgacgucugccaguu

SEQ ID NO: 221 - RNA, 21 nt, Artificial Sequence
  Synthetic polynucleotide
aacgacgacgucugccagauu

SEQ ID NO: 222 - RNA, 21 nt, Artificial Sequence
  Synthetic polynucleotide
acgacgacgucugccagaguu

SEQ ID NO: 223 - RNA, 21 nt, Artificial Sequence
  Synthetic polynucleotide
cgacgacgucugccagagguu

SEQ ID NO: 224 - RNA, 21 nt, Artificial Sequence
  Synthetic polynucleotide
gacgacgucugccagaggcuu

SEQ ID NO: 225 - RNA, 21 nt, Artificial Sequence
  Synthetic polynucleotide
acgacgucugccagaggccuu

SEQ ID NO: 226 - RNA, 21 nt, Artificial Sequence
  Synthetic polynucleotide
cgacgucugccagaggcccuu

SEQ ID NO: 227 - RNA, 21 nt, Artificial Sequence
  Synthetic polynucleotide
gacgucugccagaggcccuuu

SEQ ID NO: 228 - RNA, 21 nt, Artificial Sequence
  Synthetic polynucleotide
acgucugccagaggcccuauu

SEQ ID NO: 229 - RNA, 21 nt, Artificial Sequence
  Synthetic polynucleotide
cgucugccagaggcccuacuu

SEQ ID NO: 230 - RNA, 21 nt, Artificial Sequence
  Synthetic polynucleotide
uuccaauccauuuccaccuuu

SEQ ID NO: 231 - RNA, 21 nt, Artificial Sequence
  Synthetic polynucleotide
gucugccagaggcccuaccuu

SEQ ID NO: 232 - RNA, 21 nt, Artificial Sequence
  Synthetic polynucleotide
ucugccagaggcccuaccguu

SEQ ID NO: 233 - RNA, 21 nt, Artificial Sequence
  Synthetic polynucleotide
cugccagaggcccuaccgcuu

SEQ ID NO: 234 - RNA, 21 nt, Artificial Sequence
  Synthetic polynucleotide
ugccagaggcccuaccgcuuu

SEQ ID NO: 235 - RNA, 21 nt, Artificial Sequence
  Synthetic polynucleotide
gccagaggcccuaccgcuguu

SEQ ID NO: 236 - RNA, 21 nt, Artificial Sequence
  Synthetic polynucleotide
ccagaggcccuaccgcugguu

SEQ ID NO: 237 - RNA, 21 nt, Artificial Sequence
  Synthetic polynucleotide
cagaggcccuaccgcuggguu

SEQ ID NO: 238 - RNA, 21 nt, Artificial Sequence
  Synthetic polynucleotide
agaggcccuaccgcuggguuu

SEQ ID NO: 239 - RNA, 21 nt, Artificial Sequence
  Synthetic polynucleotide
gaggcccuaccgcugggucuu

SEQ ID NO: 240 - RNA, 21 nt, Artificial Sequence
  Synthetic polynucleotide
aggcccuaccgcugggucuuu

SEQ ID NO: 241 - RNA, 21 nt, Artificial Sequence
  Synthetic polynucleotide
uccaauccauuuccaccucuu

SEQ ID NO: 242 - RNA, 21 nt, Artificial Sequence
  Synthetic polynucleotide
ggcccuaccgcugggucuguu

SEQ ID NO: 243 - RNA, 21 nt, Artificial Sequence
  Synthetic polynucleotide
gcccuaccgcugggucugcuu

SEQ ID NO: 244 - RNA, 21 nt, Artificial Sequence
  Synthetic polynucleotide
cccuaccgcugggucugcguu

SEQ ID NO: 245 - RNA, 21 nt, Artificial Sequence
  Synthetic polynucleotide
ccuaccgcugggucugcgauu

SEQ ID NO: 246 - RNA, 21 nt, Artificial Sequence
  Synthetic polynucleotide
cuaccgcugggucugcgaguu

SEQ ID NO: 247 - RNA, 21 nt, Artificial Sequence
  Synthetic polynucleotide
uaccgcugggucugcgagauu

SEQ ID NO: 248 - RNA, 21 nt, Artificial Sequence
  Synthetic polynucleotide
accgcugggucugcgagacuu

SEQ ID NO: 249 - RNA, 21 nt, Artificial Sequence
  Synthetic polynucleotide
ccgcugggucugcgagacauu

SEQ ID NO: 250 - RNA, 21 nt, Artificial Sequence
  Synthetic polynucleotide
cgcugggucugcgagacaguu

SEQ ID NO: 251 - RNA, 21 nt, Artificial Sequence
  Synthetic polynucleotide
gcugggucugcgagacagauu

SEQ ID NO: 252 - RNA, 21 nt, Artificial Sequence
  Synthetic polynucleotide
ccaauccauuuccaccucuuu

SEQ ID NO: 253 - RNA, 21 nt, Artificial Sequence
  Synthetic polynucleotide
cugggucugcgagacagaguu

SEQ ID NO: 254 - RNA, 21 nt, Artificial Sequence
  Synthetic polynucleotide
ugggucugcgagacagagcuu

SEQ ID NO: 255 - RNA, 21 nt, Artificial Sequence
  Synthetic polynucleotide
gggucugcgagacagagcuuu

SEQ ID NO: 256 - RNA, 21 nt, Artificial Sequence
  Synthetic polynucleotide
ggucugcgagacagagcuguu

SEQ ID NO: 257 - RNA, 21 nt, Artificial Sequence
  Synthetic polynucleotide
gucugcgagacagagcugguu

SEQ ID NO: 258 - RNA, 21 nt, Artificial Sequence
  Synthetic polynucleotide
ucugcgagacagagcuggauu

SEQ ID NO: 259 - RNA, 21 nt, Artificial Sequence
  Synthetic polynucleotide
cugcgagacagagcuggacuu

SEQ ID NO: 260 - RNA, 21 nt, Artificial Sequence
  Synthetic polynucleotide
ugcgagacagagcuggacauu

SEQ ID NO: 261 - RNA, 21 nt, Artificial Sequence
  Synthetic polynucleotide
cacggaagagugaggugacuu

SEQ ID NO: 262 - RNA, 21 nt, Artificial Sequence
  Synthetic polynucleotide
gcgagacagagcuggacaauu

SEQ ID NO: 263 - RNA, 21 nt, Artificial Sequence
  Synthetic polynucleotide
cgagacagagcuggacaaguu

SEQ ID NO: 264 - RNA, 21 nt, Artificial Sequence
  Synthetic polynucleotide
caauccauuuccaccucuguu

SEQ ID NO: 265 - RNA, 21 nt, Artificial Sequence
  Synthetic polynucleotide
gagacagagcuggacaagguu

SEQ ID NO: 266 - RNA, 21 nt, Artificial Sequence
  Synthetic polynucleotide
agacagagcuggacaaggcuu

SEQ ID NO: 267 - RNA, 21 nt, Artificial Sequence
  Synthetic polynucleotide
gacagagcuggacaaggccuu

SEQ ID NO: 268 - RNA, 21 nt, Artificial Sequence
  Synthetic polynucleotide
acagagcuggacaaggccauu

SEQ ID NO: 269 - RNA, 21 nt, Artificial Sequence
  Synthetic polynucleotide
cagagcuggacaaggccaguu

SEQ ID NO: 270 - RNA, 21 nt, Artificial Sequence
  Synthetic polynucleotide
agagcuggacaaggccagcuu

SEQ ID NO: 271 - RNA, 21 nt, Artificial Sequence
  Synthetic polynucleotide
gagcuggacaaggccagccuu

SEQ ID NO: 272 - RNA, 21 nt, Artificial Sequence
  Synthetic polynucleotide
agcuggacaaggccagccauu

SEQ ID NO: 273 - RNA, 21 nt, Artificial Sequence
  Synthetic polynucleotide
gcuggacaaggccagccaguu

SEQ ID NO: 274 - RNA, 21 nt, Artificial Sequence
  Synthetic polynucleotide
cuggacaaggccagccagguu

SEQ ID NO: 275 - RNA, 21 nt, Artificial Sequence
  Synthetic polynucleotide
aauccauuuccaccucuguuu

SEQ ID NO: 276 - RNA, 21 nt, Artificial Sequence
  Synthetic polynucleotide
uggacaaggccagccaggauu

SEQ ID NO: 277 - RNA, 21 nt, Artificial Sequence
  Synthetic polynucleotide
ggacaaggccagccaggaguu

SEQ ID NO: 278 - RNA, 21 nt, Artificial Sequence
  Synthetic polynucleotide
gacaaggccagccaggagcuu

SEQ ID NO: 279 - RNA, 21 nt, Artificial Sequence
  Synthetic polynucleotide
acaaggccagccaggagccuu

SEQ ID NO: 280 - RNA, 21 nt, Artificial Sequence
  Synthetic polynucleotide
caaggccagccaggagccauu

SEQ ID NO: 281 - RNA, 21 nt, Artificial Sequence
  Synthetic polynucleotide
aaggccagccaggagccacuu

SEQ ID NO: 282 - RNA, 21 nt, Artificial Sequence
  Synthetic polynucleotide
aggccagccaggagccaccuu

SEQ ID NO: 283 - RNA, 21 nt, Artificial Sequence
  Synthetic polynucleotide
ggccagccaggagccaccuuu

SEQ ID NO: 284 - RNA, 21 nt, Artificial Sequence
  Synthetic polynucleotide
gccagccaggagccaccucuu

SEQ ID NO: 285 - RNA, 21 nt, Artificial Sequence
  Synthetic polynucleotide
ccagccaggagccaccucuuu

SEQ ID NO: 286 - RNA, 21 nt, Artificial Sequence
  Synthetic polynucleotide
auccauuuccaccucuguuuu

SEQ ID NO: 287 - RNA, 21 nt, Artificial Sequence
  Synthetic polynucleotide
cagccaggagccaccucucuu

SEQ ID NO: 288 - RNA, 21 nt, Artificial Sequence
  Synthetic polynucleotide
agccaggagccaccucuccuu

SEQ ID NO: 289 - RNA, 21 nt, Artificial Sequence
  Synthetic polynucleotide
gccaggagccaccucuccuuu

SEQ ID NO: 290 - RNA, 21 nt, Artificial Sequence
  Synthetic polynucleotide
ccaggagccaccucuccuuuu

SEQ ID NO: 291 - RNA, 21 nt, Artificial Sequence
  Synthetic polynucleotide
caggagccaccucuccuuuuu

SEQ ID NO: 292 - RNA, 21 nt, Artificial Sequence
  Synthetic polynucleotide
aggagccaccucuccuuuauu

SEQ ID NO: 293 - RNA, 21 nt, Artificial Sequence
  Synthetic polynucleotide
ggagccaccucuccuuuaauu

SEQ ID NO: 294 - RNA, 21 nt, Artificial Sequence
  Synthetic polynucleotide
gagccaccucuccuuuaauuu

SEQ ID NO: 295 - RNA, 21 nt, Artificial Sequence
  Synthetic polynucleotide
agccaccucuccuuuaauuuu

SEQ ID NO: 296 - RNA, 21 nt, Artificial Sequence
  Synthetic polynucleotide
gccaccucuccuuuaauuuuu

SEQ ID NO: 297 - RNA, 21 nt, Artificial Sequence
  Synthetic polynucleotide
uccauuuccaccucuguuuuu

SEQ ID NO: 298 - RNA, 21 nt, Artificial Sequence
  Synthetic polynucleotide
ccaccucuccuuuaauuuauu

SEQ ID NO: 299 - RNA, 21 nt, Artificial Sequence
  Synthetic polynucleotide
caccucuccuuuaauuuauuu

SEQ ID NO: 300 - RNA, 21 nt, Artificial Sequence
  Synthetic polynucleotide
accucuccuuuaauuuauuuu

SEQ ID NO: 301 - RNA, 21 nt, Artificial Sequence
  Synthetic polynucleotide
ccucuccuuuaauuuauuuuu

SEQ ID NO: 302 - RNA, 21 nt, Artificial Sequence
  Synthetic polynucleotide
cucuccuuuaauuuauuucuu

SEQ ID NO: 303 - RNA, 21 nt, Artificial Sequence
  Synthetic polynucleotide
ucuccuuuaauuuauuucuuu

SEQ ID NO: 304 - RNA, 21 nt, Artificial Sequence
  Synthetic polynucleotide
cuccuuuaauuuauuucuuuu

SEQ ID NO: 305 - RNA, 21 nt, Artificial Sequence
  Synthetic polynucleotide
uccuuuaauuuauuucuucuu

SEQ ID NO: 306 - RNA, 21 nt, Artificial Sequence
  Synthetic polynucleotide
ccuuuaauuuauuucuucauu

SEQ ID NO: 307 - RNA, 21 nt, Artificial Sequence
  Synthetic polynucleotide
cuuuaauuuauuucuucaauu

SEQ ID NO: 308 - RNA, 21 nt, Artificial Sequence
  Synthetic polynucleotide
ccauuuccaccucuguuuauu

SEQ ID NO: 309 - RNA, 21 nt, Artificial Sequence
  Synthetic polynucleotide
uuuaauuuauuucuucaauuu

SEQ ID NO: 310 - RNA, 21 nt, Artificial Sequence
  Synthetic polynucleotide
uuaauuuauuucuucaauguu

SEQ ID NO: 311 - RNA, 21 nt, Artificial Sequence
  Synthetic polynucleotide
uaauuuauuucuucaaugcuu

SEQ ID NO: 312 - RNA, 21 nt, Artificial Sequence
  Synthetic polynucleotide
aauuuauuucuucaaugccuu

SEQ ID NO: 313 - RNA, 21 nt, Artificial Sequence
  Synthetic polynucleotide
auuuauuucuucaaugccuuu

SEQ ID NO: 314 - RNA, 21 nt, Artificial Sequence
  Synthetic polynucleotide
uuuauuucuucaaugccucuu

SEQ ID NO: 315 - RNA, 21 nt, Artificial Sequence
  Synthetic polynucleotide
uuauuucuucaaugccucguu

SEQ ID NO: 316 - RNA, 21 nt, Artificial Sequence
  Synthetic polynucleotide
uauuucuucaaugccucgauu

SEQ ID NO: 317 - RNA, 21 nt, Artificial Sequence
  Synthetic polynucleotide
auuucuucaaugccucgacuu

SEQ ID NO: 318 - RNA, 21 nt, Artificial Sequence
  Synthetic polynucleotide
uuucuucaaugccucgaccuu

SEQ ID NO: 319 - RNA, 21 nt, Artificial Sequence
  Synthetic polynucleotide
cauuuccaccucuguuuacuu

SEQ ID NO: 320 - RNA, 21 nt, Artificial Sequence
  Synthetic polynucleotide
uucuucaaugccucgaccuuu

SEQ ID NO: 321 - RNA, 21 nt, Artificial Sequence
  Synthetic polynucleotide
ucuucaaugccucgaccuguu

SEQ ID NO: 322 - RNA, 21 nt, Artificial Sequence
  Synthetic polynucleotide
cuucaaugccucgaccugcuu

SEQ ID NO: 323 - RNA, 21 nt, Artificial Sequence
  Synthetic polynucleotide
uucaaugccucgaccugccuu

SEQ ID NO: 324 - RNA, 21 nt, Artificial Sequence
  Synthetic polynucleotide
ucaaugccucgaccugccguu

SEQ ID NO: 325 - RNA, 21 nt, Artificial Sequence
  Synthetic polynucleotide
caaugccucgaccugccgcuu

SEQ ID NO: 326 - RNA, 21 nt, Artificial Sequence
  Synthetic polynucleotide
aaugccucgaccugccgcauu

SEQ ID NO: 327 - RNA, 21 nt, Artificial Sequence
  Synthetic polynucleotide
augccucgaccugccgcaguu

SEQ ID NO: 328 - RNA, 21 nt, Artificial Sequence
  Synthetic polynucleotide
ugccucgaccugccgcagguu

SEQ ID NO: 329 - RNA, 21 nt, Artificial Sequence
  Synthetic polynucleotide
gccucgaccugccgcaggguu

SEQ ID NO: 330 - RNA, 21 nt, Artificial Sequence
  Synthetic polynucleotide
auuuccaccucuguuuacuuu

SEQ ID NO: 331 - RNA, 21 nt, Artificial Sequence
  Synthetic polynucleotide
ccucgaccugccgcagggguu

SEQ ID NO: 332 - RNA, 21 nt, Artificial Sequence
  Synthetic polynucleotide
cucgaccugccgcagggguuu

SEQ ID NO: 333 - RNA, 21 nt, Artificial Sequence
  Synthetic polynucleotide
ucgaccugccgcaggggucuu

SEQ ID NO: 334 - RNA, 21 nt, Artificial Sequence
  Synthetic polynucleotide
cgaccugccgcagggguccuu

SEQ ID NO: 335 - RNA, 21 nt, Artificial Sequence
  Synthetic polynucleotide
gaccugccgcagggguccguu

SEQ ID NO: 336 - RNA, 21 nt, Artificial Sequence
  Synthetic polynucleotide
accugccgcagggguccgguu

SEQ ID NO: 337 - RNA, 21 nt, Artificial Sequence
  Synthetic polynucleotide
ccugccgcagggguccggguu

SEQ ID NO: 338 - RNA, 21 nt, Artificial Sequence
  Synthetic polynucleotide
cugccgcagggguccgggauu

SEQ ID NO: 339 - RNA, 21 nt, Artificial Sequence
  Synthetic polynucleotide
ugccgcagggguccgggauuu

SEQ ID NO: 340 - RNA, 21 nt, Artificial Sequence
  Synthetic polynucleotide
gccgcagggguccgggauuuu

SEQ ID NO: 341 - RNA, 21 nt, Artificial Sequence
  Synthetic polynucleotide
uuuccaccucuguuuacuguu

SEQ ID NO: 342 - RNA, 21 nt, Artificial Sequence
  Synthetic polynucleotide
ccgcagggguccgggauuguu

SEQ ID NO: 343 - RNA, 21 nt, Artificial Sequence
  Synthetic polynucleotide
cgcagggguccgggauugguu

SEQ ID NO: 344 - RNA, 21 nt, Artificial Sequence
  Synthetic polynucleotide
gcagggguccgggauuggguu

SEQ ID NO: 345 - RNA, 21 nt, Artificial Sequence
  Synthetic polynucleotide
cagggguccgggauugggauu

SEQ ID NO: 346 - RNA, 21 nt, Artificial Sequence
  Synthetic polynucleotide
agggguccgggauugggaauu

SEQ ID NO: 347 - RNA, 21 nt, Artificial Sequence
  Synthetic polynucleotide
gggguccgggauugggaauuu

SEQ ID NO: 348 - RNA, 21 nt, Artificial Sequence
  Synthetic polynucleotide
ggguccgggauugggaaucuu

SEQ ID NO: 349 - RNA, 21 nt, Artificial Sequence
  Synthetic polynucleotide
gguccgggauugggaauccuu

SEQ ID NO: 350 - RNA, 21 nt, Artificial Sequence
  Synthetic polynucleotide
guccgggauugggaauccguu

SEQ ID NO: 351 - RNA, 21 nt, Artificial Sequence
  Synthetic polynucleotide
uccgggauugggaauccgcuu

SEQ ID NO: 352 - RNA, 21 nt, Artificial Sequence
  Synthetic polynucleotide
uuccaccucuguuuacuguuu

SEQ ID NO: 353 - RNA, 21 nt, Artificial Sequence
  Synthetic polynucleotide
ccgggauugggaauccgccuu

SEQ ID NO: 354 - RNA, 21 nt, Artificial Sequence
  Synthetic polynucleotide
cgggauugggaauccgcccuu

SEQ ID NO: 355 - RNA, 21 nt, Artificial Sequence
  Synthetic polynucleotide
gggauugggaauccgcccauu

SEQ ID NO: 356 - RNA, 21 nt, Artificial Sequence
  Synthetic polynucleotide
ggauugggaauccgcccauuu

SEQ ID NO: 357 - RNA, 21 nt, Artificial Sequence
  Synthetic polynucleotide
gauugggaauccgcccaucuu

SEQ ID NO: 358 - RNA, 21 nt, Artificial Sequence
  Synthetic polynucleotide
auugggaauccgcccaucuuu

SEQ ID NO: 359 - RNA, 21 nt, Artificial Sequence
  Synthetic polynucleotide
uugggaauccgcccaucuguu

SEQ ID NO: 360 - RNA, 21 nt, Artificial Sequence
  Synthetic polynucleotide
ugggaauccgcccaucugguu

SEQ ID NO: 361 - RNA, 21 nt, Artificial Sequence
  Synthetic polynucleotide
gggaauccgcccaucuggguu

SEQ ID NO: 362 - RNA, 21 nt, Artificial Sequence
  Synthetic polynucleotide
ggaauccgcccaucugggguu

SEQ ID NO: 363 - RNA, 21 nt, Artificial Sequence
  Synthetic polynucleotide
uccaccucuguuuacugucuu

SEQ ID NO: 364 - RNA, 21 nt, Artificial Sequence
  Synthetic polynucleotide
gaauccgcccaucuggggguu

SEQ ID NO: 365 - RNA, 21 nt, Artificial Sequence
  Synthetic polynucleotide
aauccgcccaucugggggcuu

SEQ ID NO: 366 - RNA, 21 nt, Artificial Sequence
  Synthetic polynucleotide
auccgcccaucugggggccuu

SEQ ID NO: 367 - RNA, 21 nt, Artificial Sequence
  Synthetic polynucleotide
uccgcccaucugggggccuuu

SEQ ID NO: 368 - RNA, 21 nt, Artificial Sequence
  Synthetic polynucleotide
ccgcccaucugggggccucuu

SEQ ID NO: 369 - RNA, 21 nt, Artificial Sequence
  Synthetic polynucleotide
cgcccaucugggggccucuuu

SEQ ID NO: 370 - RNA, 21 nt, Artificial Sequence
  Synthetic polynucleotide
gcccaucugggggccucuuuu

SEQ ID NO: 371 - RNA, 21 nt, Artificial Sequence
  Synthetic polynucleotide
cccaucugggggccucuucuu

SEQ ID NO: 372 - RNA, 21 nt, Artificial Sequence
  Synthetic polynucleotide
ccaucugggggccucuucuuu

SEQ ID NO: 373 - RNA, 21 nt, Artificial Sequence
  Synthetic polynucleotide
acggaagagugaggugacuuu

SEQ ID NO: 374 - RNA, 21 nt, Artificial Sequence
  Synthetic polynucleotide
caucugggggccucuucuguu

SEQ ID NO: 375 - RNA, 21 nt, Artificial Sequence
  Synthetic polynucleotide
ccaccucuguuuacuguccuu

SEQ ID NO: 376 - RNA, 21 nt, Artificial Sequence
  Synthetic polynucleotide
aucugggggccucuucugcuu

SEQ ID NO: 377 - RNA, 21 nt, Artificial Sequence
  Synthetic polynucleotide
ucugggggccucuucugcuuu

SEQ ID NO: 378 - RNA, 21 nt, Artificial Sequence
  Synthetic polynucleotide
cugggggccucuucugcuuuu

SEQ ID NO: 379 - RNA, 21 nt, Artificial Sequence
  Synthetic polynucleotide
ugggggccucuucugcuuuuu

SEQ ID NO: 380 - RNA, 21 nt, Artificial Sequence
  Synthetic polynucleotide
gggggccucuucugcuuucuu

SEQ ID NO: 381 - RNA, 21 nt, Artificial Sequence
  Synthetic polynucleotide
ggggccucuucugcuuucuuu

SEQ ID NO: 382 - RNA, 21 nt, Artificial Sequence
  Synthetic polynucleotide
gggccucuucugcuuucucuu

SEQ ID NO: 383 - RNA, 21 nt, Artificial Sequence
  Synthetic polynucleotide
ggccucuucugcuuucucguu

SEQ ID NO: 384 - RNA, 21 nt, Artificial Sequence
  Synthetic polynucleotide
gccucuucugcuuucucgguu

SEQ ID NO: 385 - RNA, 21 nt, Artificial Sequence
  Synthetic polynucleotide
ccucuucugcuuucucggguu

SEQ ID NO: 386 - RNA, 21 nt, Artificial Sequence
  Synthetic polynucleotide
caccucuguuuacuguccauu

SEQ ID NO: 387 - RNA, 21 nt, Artificial Sequence
  Synthetic polynucleotide
cucuucugcuuucucgggauu

SEQ ID NO: 388 - RNA, 21 nt, Artificial Sequence
  Synthetic polynucleotide
ucuucugcuuucucgggaauu

SEQ ID NO: 389 - RNA, 21 nt, Artificial Sequence
  Synthetic polynucleotide
cuucugcuuucucgggaauuu

SEQ ID NO: 390 - RNA, 21 nt, Artificial Sequence
  Synthetic polynucleotide
uucugcuuucucgggaauuuu

SEQ ID NO: 391 - RNA, 21 nt, Artificial Sequence
  Synthetic polynucleotide
ucugcuuucucgggaauuuuu

SEQ ID NO: 392 - RNA, 21 nt, Artificial Sequence
  Synthetic polynucleotide
cugcuuucucgggaauuuuuu

SEQ ID NO: 393 - RNA, 21 nt, Artificial Sequence
  Synthetic polynucleotide
ugcuuucucgggaauuuucuu

SEQ ID NO: 394 - RNA, 21 nt, Artificial Sequence
  Synthetic polynucleotide
gcuuucucgggaauuuucauu

SEQ ID NO: 395 - RNA, 21 nt, Artificial Sequence
  Synthetic polynucleotide
cuuucucgggaauuuucauuu

SEQ ID NO: 396 - RNA, 21 nt, Artificial Sequence
  Synthetic polynucleotide
uuucucgggaauuuucaucuu

SEQ ID NO: 397 - RNA, 21 nt, Artificial Sequence
  Synthetic polynucleotide
accucuguuuacuguccaauu

SEQ ID NO: 398 - RNA, 21 nt, Artificial Sequence
  Synthetic polynucleotide
uucucgggaauuuucaucuuu

SEQ ID NO: 399 - RNA, 21 nt, Artificial Sequence
  Synthetic polynucleotide
ucucgggaauuuucaucuauu

SEQ ID NO: 400 - RNA, 21 nt, Artificial Sequence
  Synthetic polynucleotide
cucgggaauuuucaucuaguu

SEQ ID NO: 401 - RNA, 21 nt, Artificial Sequence
  Synthetic polynucleotide
ucgggaauuuucaucuagguu

SEQ ID NO: 402 - RNA, 21 nt, Artificial Sequence
  Synthetic polynucleotide
cgggaauuuucaucuaggauu

SEQ ID NO: 403 - RNA, 21 nt, Artificial Sequence
  Synthetic polynucleotide
gggaauuuucaucuaggauuu

SEQ ID NO: 404 - RNA, 21 nt, Artificial Sequence
  Synthetic polynucleotide
ggaauuuucaucuaggauuuu

SEQ ID NO: 405 - RNA, 21 nt, Artificial Sequence
  Synthetic polynucleotide
gaauuuucaucuaggauuuuu

SEQ ID NO: 406 - RNA, 21 nt, Artificial Sequence
  Synthetic polynucleotide
aauuuucaucuaggauuuuuu

SEQ ID NO: 407 - RNA, 21 nt, Artificial Sequence
  Synthetic polynucleotide
auuuucaucuaggauuuuauu

SEQ ID NO: 408 - RNA, 21 nt, Artificial Sequence
  Synthetic polynucleotide
ccucuguuuacuguccaaauu

SEQ ID NO: 409 - RNA, 21 nt, Artificial Sequence
  Synthetic polynucleotide
uuuucaucuaggauuuuaauu

SEQ ID NO: 410 - RNA, 21 nt, Artificial Sequence
  Synthetic polynucleotide
uuucaucuaggauuuuaaguu

SEQ ID NO: 411 - RNA, 21 nt, Artificial Sequence
  Synthetic polynucleotide
uucaucuaggauuuuaagguu

SEQ ID NO: 412 - RNA, 21 nt, Artificial Sequence
  Synthetic polynucleotide
ucaucuaggauuuuaaggguu

SEQ ID NO: 413 - RNA, 21 nt, Artificial Sequence
  Synthetic polynucleotide
caucuaggauuuuaagggauu

SEQ ID NO: 414 - RNA, 21 nt, Artificial Sequence
  Synthetic polynucleotide
aucuaggauuuuaagggaauu

SEQ ID NO: 415 - RNA, 21 nt, Artificial Sequence
  Synthetic polynucleotide
ucuaggauuuuaagggaaguu

SEQ ID NO: 416 - RNA, 21 nt, Artificial Sequence
  Synthetic polynucleotide
cuaggauuuuaagggaagguu

SEQ ID NO: 417 - RNA, 21 nt, Artificial Sequence
  Synthetic polynucleotide
uaggauuuuaagggaaggguu

SEQ ID NO: 418 - RNA, 21 nt, Artificial Sequence
  Synthetic polynucleotide
aggauuuuaagggaagggguu

SEQ ID NO: 419 - RNA, 21 nt, Artificial Sequence
  Synthetic polynucleotide
cucuguuuacuguccaaaguu

SEQ ID NO: 420 - RNA, 21 nt, Artificial Sequence
  Synthetic polynucleotide
ggauuuuaagggaaggggauu

SEQ ID NO: 421 - RNA, 21 nt, Artificial Sequence
  Synthetic polynucleotide
gauuuuaagggaaggggaauu

SEQ ID NO: 422 - RNA, 21 nt, Artificial Sequence
  Synthetic polynucleotide
auuuuaagggaaggggaaguu

SEQ ID NO: 423 - RNA, 21 nt, Artificial Sequence
  Synthetic polynucleotide
uuuuaagggaaggggaagguu

SEQ ID NO: 424 - RNA, 21 nt, Artificial Sequence
  Synthetic polynucleotide
uuuaagggaaggggaaggauu

SEQ ID NO: 425 - RNA, 21 nt, Artificial Sequence
  Synthetic polynucleotide
uuaagggaaggggaaggauuu

SEQ ID NO: 426 - RNA, 21 nt, Artificial Sequence
  Synthetic polynucleotide
uaagggaaggggaaggauauu

SEQ ID NO: 427 - RNA, 21 nt, Artificial Sequence
  Synthetic polynucleotide
aagggaaggggaaggauaguu

SEQ ID NO: 428 - RNA, 21 nt, Artificial Sequence
  Synthetic polynucleotide
agggaaggggaaggauagguu

SEQ ID NO: 429 - RNA, 21 nt, Artificial Sequence
  Synthetic polynucleotide
gggaaggggaaggauaggguu

SEQ ID NO: 430 - RNA, 21 nt, Artificial Sequence
  Synthetic polynucleotide
ucuguuuacuguccaaaguuu

SEQ ID NO: 431 - RNA, 21 nt, Artificial Sequence
  Synthetic polynucleotide
ggaaggggaaggauaggguuu

SEQ ID NO: 432 - RNA, 21 nt, Artificial Sequence
  Synthetic polynucleotide
gaaggggaaggauaggguguu

SEQ ID NO: 433 - RNA, 21 nt, Artificial Sequence
  Synthetic polynucleotide
aaggggaaggauagggugauu

SEQ ID NO: 434 - RNA, 21 nt, Artificial Sequence
  Synthetic polynucleotide
aggggaaggauagggugauuu

SEQ ID NO: 435 - RNA, 21 nt, Artificial Sequence
  Synthetic polynucleotide
ggggaaggauagggugauguu

SEQ ID NO: 436 - RNA, 21 nt, Artificial Sequence
  Synthetic polynucleotide
gggaaggauagggugauguuu

SEQ ID NO: 437 - RNA, 21 nt, Artificial Sequence
  Synthetic polynucleotide
ggaaggauagggugauguuuu

SEQ ID NO: 438 - RNA, 21 nt, Artificial Sequence
  Synthetic polynucleotide
gaaggauagggugauguucuu

SEQ ID NO: 439 - RNA, 21 nt, Artificial Sequence
  Synthetic polynucleotide
aaggauagggugauguuccuu

SEQ ID NO: 440 - RNA, 21 nt, Artificial Sequence
  Synthetic polynucleotide
aggauagggugauguuccguu

SEQ ID NO: 441 - RNA, 21 nt, Artificial Sequence
  Synthetic polynucleotide
cuguuuacuguccaaagucuu

SEQ ID NO: 442 - RNA, 21 nt, Artificial Sequence
  Synthetic polynucleotide
ggauagggugauguuccgauu

SEQ ID NO: 443 - RNA, 21 nt, Artificial Sequence
  Synthetic polynucleotide
gauagggugauguuccgaauu

SEQ ID NO: 444 - RNA, 21 nt, Artificial Sequence
  Synthetic polynucleotide
auagggugauguuccgaaguu

SEQ ID NO: 445 - RNA, 21 nt, Artificial Sequence
  Synthetic polynucleotide
uagggugauguuccgaagguu

SEQ ID NO: 446 - RNA, 21 nt, Artificial Sequence
  Synthetic polynucleotide
agggugauguuccgaagguuu

SEQ ID NO: 447 - RNA, 21 nt, Artificial Sequence
  Synthetic polynucleotide
gggugauguuccgaagguguu

SEQ ID NO: 448 - RNA, 21 nt, Artificial Sequence
  Synthetic polynucleotide
ggugauguuccgaaggugauu

SEQ ID NO: 449 - RNA, 21 nt, Artificial Sequence
  Synthetic polynucleotide
gugauguuccgaaggugaguu

SEQ ID NO: 450 - RNA, 21 nt, Artificial Sequence
  Synthetic polynucleotide
ugauguuccgaaggugagguu

SEQ ID NO: 451 - RNA, 21 nt, Artificial Sequence
  Synthetic polynucleotide
gauguuccgaaggugaggauu

SEQ ID NO: 452 - RNA, 21 nt, Artificial Sequence
  Synthetic polynucleotide
uguuuacuguccaaaguccuu

SEQ ID NO: 453 - RNA, 21 nt, Artificial Sequence
  Synthetic polynucleotide
auguuccgaaggugaggaguu

SEQ ID NO: 454 - RNA, 21 nt, Artificial Sequence
  Synthetic polynucleotide
uguuccgaaggugaggagcuu

SEQ ID NO: 455 - RNA, 21 nt, Artificial Sequence
  Synthetic polynucleotide
guuccgaaggugaggagcuuu

SEQ ID NO: 456 - RNA, 21 nt, Artificial Sequence
  Synthetic polynucleotide
uuccgaaggugaggagcuuuu

SEQ ID NO: 457 - RNA, 21 nt, Artificial Sequence
  Synthetic polynucleotide
uccgaaggugaggagcuuguu

SEQ ID NO: 458 - RNA, 21 nt, Artificial Sequence
  Synthetic polynucleotide
ccgaaggugaggagcuugauu

SEQ ID NO: 459 - RNA, 21 nt, Artificial Sequence
  Synthetic polynucleotide
cgaaggugaggagcuugaauu

SEQ ID NO: 460 - RNA, 21 nt, Artificial Sequence
  Synthetic polynucleotide
gaaggugaggagcuugaaauu

SEQ ID NO: 461 - RNA, 21 nt, Artificial Sequence
  Synthetic polynucleotide
aaggugaggagcuugaaacuu

SEQ ID NO: 462 - RNA, 21 nt, Artificial Sequence
  Synthetic polynucleotide
aggugaggagcuugaaaccuu

SEQ ID NO: 463 - RNA, 21 nt, Artificial Sequence
  Synthetic polynucleotide
guuuacuguccaaagucccuu

SEQ ID NO: 464 - RNA, 21 nt, Artificial Sequence
  Synthetic polynucleotide
ggugaggagcuugaaacccuu

SEQ ID NO: 465 - RNA, 21 nt, Artificial Sequence
  Synthetic polynucleotide
gugaggagcuugaaacccguu

SEQ ID NO: 466 - RNA, 21 nt, Artificial Sequence
  Synthetic polynucleotide
ugaggagcuugaaacccguuu

SEQ ID NO: 467 - RNA, 21 nt, Artificial Sequence
  Synthetic polynucleotide
gaggagcuugaaacccguguu

SEQ ID NO: 468 - RNA, 21 nt, Artificial Sequence
  Synthetic polynucleotide
aggagcuugaaacccgugguu

SEQ ID NO: 469 - RNA, 21 nt, Artificial Sequence
  Synthetic polynucleotide
ggagcuugaaacccguggcuu

SEQ ID NO: 470 - RNA, 21 nt, Artificial Sequence
  Synthetic polynucleotide
gagcuugaaacccguggcguu

SEQ ID NO: 471 - RNA, 21 nt, Artificial Sequence
  Synthetic polynucleotide
agcuugaaacccguggcgcuu

SEQ ID NO: 472 - RNA, 21 nt, Artificial Sequence
  Synthetic polynucleotide
gcuugaaacccguggcgcuuu

SEQ ID NO: 473 - RNA, 21 nt, Artificial Sequence
  Synthetic polynucleotide
cuugaaacccguggcgcuuuu

SEQ ID NO: 474 - RNA, 21 nt, Artificial Sequence
  Synthetic polynucleotide
uuuacuguccaaagucccguu

SEQ ID NO: 475 - RNA, 21 nt, Artificial Sequence
  Synthetic polynucleotide
uugaaacccguggcgcuuuuu

SEQ ID NO: 476 - RNA, 21 nt, Artificial Sequence
  Synthetic polynucleotide
ugaaacccguggcgcuuucuu

SEQ ID NO: 477 - RNA, 21 nt, Artificial Sequence
  Synthetic polynucleotide
gaaacccguggcgcuuucuuu

SEQ ID NO: 478 - RNA, 21 nt, Artificial Sequence
  Synthetic polynucleotide
aaacccguggcgcuuucuguu

SEQ ID NO: 479 - RNA, 21 nt, Artificial Sequence
  Synthetic polynucleotide
aacccguggcgcuuucugcuu

SEQ ID NO: 480 - RNA, 21 nt, Artificial Sequence
  Synthetic polynucleotide
acccguggcgcuuucugcauu

SEQ ID NO: 481 - RNA, 21 nt, Artificial Sequence
  Synthetic polynucleotide
cccguggcgcuuucugcaguu

SEQ ID NO: 482 - RNA, 21 nt, Artificial Sequence
  Synthetic polynucleotide
ccguggcgcuuucugcaguuu

SEQ ID NO: 483 - RNA, 21 nt, Artificial Sequence
  Synthetic polynucleotide
cguggcgcuuucugcaguuuu

SEQ ID NO: 484 - RNA, 21 nt, Artificial Sequence
  Synthetic polynucleotide
guggcgcuuucugcaguuuuu

SEQ ID NO: 485 - RNA, 21 nt, Artificial Sequence
  Synthetic polynucleotide
uuacuguccaaagucccgguu

SEQ ID NO: 486 - RNA, 21 nt, Artificial Sequence
  Synthetic polynucleotide
cggaagagugaggugacuguu

SEQ ID NO: 487 - RNA, 21 nt, Artificial Sequence
  Synthetic polynucleotide
uggcgcuuucugcaguuuguu

SEQ ID NO: 488 - RNA, 21 nt, Artificial Sequence
  Synthetic polynucleotide
ggcgcuuucugcaguuugcuu

SEQ ID NO: 489 - RNA, 21 nt, Artificial Sequence
  Synthetic polynucleotide
gcgcuuucugcaguuugcauu

SEQ ID NO: 490 - RNA, 21 nt, Artificial Sequence
  Synthetic polynucleotide
cgcuuucugcaguuugcaguu

SEQ ID NO: 491 - RNA, 21 nt, Artificial Sequence
  Synthetic polynucleotide
gcuuucugcaguuugcagguu

SEQ ID NO: 492 - RNA, 21 nt, Artificial Sequence
  Synthetic polynucleotide
cuuucugcaguuugcagguuu

SEQ ID NO: 493 - RNA, 21 nt, Artificial Sequence
  Synthetic polynucleotide
uuucugcaguuugcagguuuu

SEQ ID NO: 494 - RNA, 21 nt, Artificial Sequence
  Synthetic polynucleotide
uucugcaguuugcagguuauu

SEQ ID NO: 495 - RNA, 21 nt, Artificial Sequence
  Synthetic polynucleotide
ucugcaguuugcagguuauuu

SEQ ID NO: 496 - RNA, 21 nt, Artificial Sequence
  Synthetic polynucleotide
cugcaguuugcagguuaucuu

SEQ ID NO: 497 - RNA, 21 nt, Artificial Sequence
  Synthetic polynucleotide
uacuguccaaagucccggguu

SEQ ID NO: 498 - RNA, 21 nt, Artificial Sequence
  Synthetic polynucleotide
ugcaguuugcagguuaucauu

SEQ ID NO: 499 - RNA, 21 nt, Artificial Sequence
  Synthetic polynucleotide
gcaguuugcagguuaucauuu

SEQ ID NO: 500 - RNA, 21 nt, Artificial Sequence
  Synthetic polynucleotide
caguuugcagguuaucauuuu

SEQ ID NO: 501 - RNA, 21 nt, Artificial Sequence
  Synthetic polynucleotide
aguuugcagguuaucauuguu

SEQ ID NO: 502 - RNA, 21 nt, Artificial Sequence
  Synthetic polynucleotide
guuugcagguuaucauuguuu

SEQ ID NO: 503 - RNA, 21 nt, Artificial Sequence
  Synthetic polynucleotide
uuugcagguuaucauuguguu

SEQ ID NO: 504 - RNA, 21 nt, Artificial Sequence
  Synthetic polynucleotide
uugcagguuaucauugugauu

SEQ ID NO: 505 - RNA, 21 nt, Artificial Sequence
  Synthetic polynucleotide
ugcagguuaucauugugaauu

SEQ ID NO: 506 - RNA, 21 nt, Artificial Sequence
  Synthetic polynucleotide
gcagguuaucauugugaacuu

SEQ ID NO: 507 - RNA, 21 nt, Artificial Sequence
  Synthetic polynucleotide
cagguuaucauugugaacuuu

SEQ ID NO: 508 - RNA, 21 nt, Artificial Sequence
  Synthetic polynucleotide
acuguccaaagucccgggcuu

SEQ ID NO: 509 - RNA, 21 nt, Artificial Sequence
  Synthetic polynucleotide
agguuaucauugugaacuuuu

SEQ ID NO: 510 - RNA, 21 nt, Artificial Sequence
  Synthetic polynucleotide
gguuaucauugugaacuuuuu

SEQ ID NO: 511 - RNA, 21 nt, Artificial Sequence
  Synthetic polynucleotide
guuaucauugugaacuuuuuu

SEQ ID NO: 512 - RNA, 21 nt, Artificial Sequence
  Synthetic polynucleotide
uuaucauugugaacuuuuuuu

SEQ ID NO: 513 - RNA, 21 nt, Artificial Sequence
  Synthetic polynucleotide
uaucauugugaacuuuuuuuu

SEQ ID NO: 514 - RNA, 21 nt, Artificial Sequence
  Synthetic polynucleotide
aucauugugaacuuuuuuuuu

SEQ ID NO: 515 - RNA, 21 nt, Artificial Sequence
  Synthetic polynucleotide
ucauugugaacuuuuuuuuuu

SEQ ID NO: 516 - RNA, 21 nt, Artificial Sequence
  Synthetic polynucleotide
cauugugaacuuuuuuuuuuu

SEQ ID NO: 517 - RNA, 21 nt, Artificial Sequence
  Synthetic polynucleotide
auugugaacuuuuuuuuuuuu

SEQ ID NO: 518 - RNA, 21 nt, Artificial Sequence
  Synthetic polynucleotide
uugugaacuuuuuuuuuuuuu

SEQ ID NO: 519 - RNA, 21 nt, Artificial Sequence
  Synthetic polynucleotide
cuguccaaagucccgggcauu

SEQ ID NO: 520 - RNA, 21 nt, Artificial Sequence
  Synthetic polynucleotide
ugugaacuuuuuuuuuuuauu

SEQ ID NO: 521 - RNA, 21 nt, Artificial Sequence
  Synthetic polynucleotide
gugaacuuuuuuuuuuuaauu

SEQ ID NO: 522 - RNA, 21 nt, Artificial Sequence
  Synthetic polynucleotide
ugaacuuuuuuuuuuuaaguu

SEQ ID NO: 523 - RNA, 21 nt, Artificial Sequence
  Synthetic polynucleotide
gaacuuuuuuuuuuuaagauu

SEQ ID NO: 524 - RNA, 21 nt, Artificial Sequence
  Synthetic polynucleotide
aacuuuuuuuuuuuaagaguu

SEQ ID NO: 525 - RNA, 21 nt, Artificial Sequence
  Synthetic polynucleotide
acuuuuuuuuuuuaagaguuu

SEQ ID NO: 526 - RNA, 21 nt, Artificial Sequence
  Synthetic polynucleotide
cuuuuuuuuuuuaagaguauu

SEQ ID NO: 527 - RNA, 21 nt, Artificial Sequence
  Synthetic polynucleotide
uuuuuuuuuuuaagaguaauu

SEQ ID NO: 528 - RNA, 21 nt, Artificial Sequence
  Synthetic polynucleotide
uuuuuuuuuuaagaguaaauu

SEQ ID NO: 529 - RNA, 21 nt, Artificial Sequence
  Synthetic polynucleotide
uuuuuuuuuaagaguaaaauu

SEQ ID NO: 530 - RNA, 21 nt, Artificial Sequence
  Synthetic polynucleotide
uguccaaagucccgggcacuu

SEQ ID NO: 531 - RNA, 21 nt, Artificial Sequence
  Synthetic polynucleotide
uuuuuuuuaagaguaaaaauu

SEQ ID NO: 532 - RNA, 21 nt, Artificial Sequence
  Synthetic polynucleotide
uuuuuuuaagaguaaaaaguu

SEQ ID NO: 533 - RNA, 21 nt, Artificial Sequence
  Synthetic polynucleotide
uuuuuuaagaguaaaaagauu

SEQ ID NO: 534 - RNA, 21 nt, Artificial Sequence
  Synthetic polynucleotide
uuuuuaagaguaaaaagaauu

SEQ ID NO: 535 - RNA, 21 nt, Artificial Sequence
  Synthetic polynucleotide
uuuuaagaguaaaaagaaauu

SEQ ID NO: 536 - RNA, 21 nt, Artificial Sequence
  Synthetic polynucleotide
uuuaagaguaaaaagaaauuu

SEQ ID NO: 537 - RNA, 21 nt, Artificial Sequence
  Synthetic polynucleotide
uuaagaguaaaaagaaauauu

SEQ ID NO: 538 - RNA, 21 nt, Artificial Sequence
  Synthetic polynucleotide
uaagaguaaaaagaaauauuu

SEQ ID NO: 539 - RNA, 21 nt, Artificial Sequence
  Synthetic polynucleotide
aagaguaaaaagaaauauauu

SEQ ID NO: 540 - RNA, 21 nt, Artificial Sequence
  Synthetic polynucleotide
agaguaaaaagaaauauacuu

SEQ ID NO: 541 - RNA, 21 nt, Artificial Sequence
  Synthetic polynucleotide
guccaaagucccgggcacuuu

SEQ ID NO: 542 - RNA, 21 nt, Artificial Sequence
  Synthetic polynucleotide
gaguaaaaagaaauauaccuu

SEQ ID NO: 543 - RNA, 21 nt, Artificial Sequence
  Synthetic polynucleotide
aguaaaaagaaauauaccuuu

SEQ ID NO: 544 - RNA, 21 nt, Artificial Sequence
  Synthetic polynucleotide
guaaaaagaaauauaccuauu

SEQ ID NO: 545 - RNA, 21 nt, Artificial Sequence
  Synthetic polynucleotide
uaaaaagaaauauaccuaauu

SEQ ID NO: 546 - RNA, 21 nt, Artificial Sequence
  Synthetic polynucleotide
uccaaagucccgggcacuguu

SEQ ID NO: 547 - RNA, 21 nt, Artificial Sequence
  Synthetic polynucleotide
ccaaagucccgggcacugguu

SEQ ID NO: 548 - RNA, 21 nt, Artificial Sequence
  Synthetic polynucleotide
caaagucccgggcacuggauu

SEQ ID NO: 549 - RNA, 21 nt, Artificial Sequence
  Synthetic polynucleotide
aaagucccgggcacuggaguu

SEQ ID NO: 550 - RNA, 21 nt, Artificial Sequence
  Synthetic polynucleotide
aagucccgggcacuggagauu

SEQ ID NO: 551 - RNA, 21 nt, Artificial Sequence
  Synthetic polynucleotide
ggaagagugaggugacugguu

SEQ ID NO: 552 - RNA, 21 nt, Artificial Sequence
  Synthetic polynucleotide
agucccgggcacuggagauuu

SEQ ID NO: 553 - RNA, 21 nt, Artificial Sequence
  Synthetic polynucleotide
gucccgggcacuggagauguu

SEQ ID NO: 554 - RNA, 21 nt, Artificial Sequence
  Synthetic polynucleotide
ucccgggcacuggagaugcuu

SEQ ID NO: 555 - RNA, 21 nt, Artificial Sequence
  Synthetic polynucleotide
cccgggcacuggagaugccuu

SEQ ID NO: 556 - RNA, 21 nt, Artificial Sequence
  Synthetic polynucleotide
ccgggcacuggagaugccauu

SEQ ID NO: 557 - RNA, 21 nt, Artificial Sequence
  Synthetic polynucleotide
cgggcacuggagaugccacuu

SEQ ID NO: 558 - RNA, 21 nt, Artificial Sequence
  Synthetic polynucleotide
gggcacuggagaugccacguu

SEQ ID NO: 559 - RNA, 21 nt, Artificial Sequence
  Synthetic polynucleotide
ggcacuggagaugccacguuu

SEQ ID NO: 560 - RNA, 21 nt, Artificial Sequence
  Synthetic polynucleotide
gcacuggagaugccacguuuu

SEQ ID NO: 561 - RNA, 21 nt, Artificial Sequence
  Synthetic polynucleotide
cacuggagaugccacguuuuu

SEQ ID NO: 562 - RNA, 21 nt, Artificial Sequence
  Synthetic polynucleotide
gaagagugaggugacuggcuu

SEQ ID NO: 563 - RNA, 21 nt, Artificial Sequence
  Synthetic polynucleotide
acuggagaugccacguuuguu

SEQ ID NO: 564 - RNA, 21 nt, Artificial Sequence
  Synthetic polynucleotide
cuggagaugccacguuugguu

SEQ ID NO: 565 - RNA, 21 nt, Artificial Sequence
  Synthetic polynucleotide
uggagaugccacguuuggcuu

SEQ ID NO: 566 - RNA, 21 nt, Artificial Sequence
  Synthetic polynucleotide
ggagaugccacguuuggcguu

SEQ ID NO: 567 - RNA, 21 nt, Artificial Sequence
  Synthetic polynucleotide
gagaugccacguuuggcguuu

SEQ ID NO: 568 - RNA, 21 nt, Artificial Sequence
  Synthetic polynucleotide
agaugccacguuuggcguguu

SEQ ID NO: 569 - RNA, 21 nt, Artificial Sequence
  Synthetic polynucleotide
gaugccacguuuggcgugcuu

SEQ ID NO: 570 - RNA, 21 nt, Artificial Sequence
  Synthetic polynucleotide
augccacguuuggcgugcuuu

SEQ ID NO: 571 - RNA, 21 nt, Artificial Sequence
  Synthetic polynucleotide
ugccacguuuggcgugcuuuu

SEQ ID NO: 572 - RNA, 21 nt, Artificial Sequence
  Synthetic polynucleotide
gccacguuuggcgugcuuguu

SEQ ID NO: 573 - RNA, 21 nt, Artificial Sequence
  Synthetic polynucleotide
aagagugaggugacuggcauu

SEQ ID NO: 574 - RNA, 21 nt, Artificial Sequence
  Synthetic polynucleotide
ccacguuuggcgugcuugguu

SEQ ID NO: 575 - RNA, 21 nt, Artificial Sequence
  Synthetic polynucleotide
cacguuuggcgugcuuggauu

SEQ ID NO: 576 - RNA, 21 nt, Artificial Sequence
  Synthetic polynucleotide
acguuuggcgugcuuggacuu

SEQ ID NO: 577 - RNA, 21 nt, Artificial Sequence
  Synthetic polynucleotide
cguuuggcgugcuuggacauu

SEQ ID NO: 578 - RNA, 21 nt, Artificial Sequence
  Synthetic polynucleotide
guuuggcgugcuuggacacuu

SEQ ID NO: 579 - RNA, 21 nt, Artificial Sequence
  Synthetic polynucleotide
uuuggcgugcuuggacacauu

SEQ ID NO: 580 - RNA, 21 nt, Artificial Sequence
  Synthetic polynucleotide
uuggcgugcuuggacacacuu

SEQ ID NO: 581 - RNA, 21 nt, Artificial Sequence
  Synthetic polynucleotide
uggcgugcuuggacacacauu

SEQ ID NO: 582 - RNA, 21 nt, Artificial Sequence
  Synthetic polynucleotide
ggcgugcuuggacacacaguu

SEQ ID NO: 583 - RNA, 21 nt, Artificial Sequence
  Synthetic polynucleotide
gcgugcuuggacacacagauu

SEQ ID NO: 584 - RNA, 21 nt, Artificial Sequence
  Synthetic polynucleotide
agagugaggugacuggcauuu

SEQ ID NO: 585 - RNA, 21 nt, Artificial Sequence
  Synthetic polynucleotide
cgugcuuggacacacagacuu

SEQ ID NO: 586 - RNA, 21 nt, Artificial Sequence
  Synthetic polynucleotide
gugcuuggacacacagacauu

SEQ ID NO: 587 - RNA, 21 nt, Artificial Sequence
  Synthetic polynucleotide
ugcuuggacacacagacacuu

SEQ ID NO: 588 - RNA, 21 nt, Artificial Sequence
  Synthetic polynucleotide
gcuuggacacacagacacguu

SEQ ID NO: 589 - RNA, 21 nt, Artificial Sequence
  Synthetic polynucleotide
cuuggacacacagacacgcuu

SEQ ID NO: 590 - RNA, 21 nt, Artificial Sequence
  Synthetic polynucleotide
uuggacacacagacacgcauu

SEQ ID NO: 591 - RNA, 21 nt, Artificial Sequence
  Synthetic polynucleotide
uggacacacagacacgcaguu

SEQ ID NO: 592 - RNA, 21 nt, Artificial Sequence
  Synthetic polynucleotide
ggacacacagacacgcagauu

SEQ ID NO: 593 - RNA, 21 nt, Artificial Sequence
  Synthetic polynucleotide
gacacacagacacgcagacuu

SEQ ID NO: 594 - RNA, 21 nt, Artificial Sequence
  Synthetic polynucleotide
acacacagacacgcagacauu

SEQ ID NO: 595 - RNA, 21 nt, Artificial Sequence
  Synthetic polynucleotide
gagugaggugacuggcauguu

SEQ ID NO: 596 - RNA, 21 nt, Artificial Sequence
  Synthetic polynucleotide
cacacagacacgcagacacuu

SEQ ID NO: 597 - RNA, 21 nt, Artificial Sequence
  Synthetic polynucleotide
acacagacacgcagacacauu

SEQ ID NO: 598 - RNA, 21 nt, Artificial Sequence
  Synthetic polynucleotide
cacagacacgcagacacaguu

SEQ ID NO: 599 - RNA, 21 nt, Artificial Sequence
  Synthetic polynucleotide
acagacacgcagacacagauu

SEQ ID NO: 600 - RNA, 21 nt, Artificial Sequence
  Synthetic polynucleotide
cagacacgcagacacagaguu

SEQ ID NO: 601 - RNA, 21 nt, Artificial Sequence
  Synthetic polynucleotide
agacacgcagacacagagauu

SEQ ID NO: 602 - RNA, 21 nt, Artificial Sequence
  Synthetic polynucleotide
gacacgcagacacagagacuu

SEQ ID NO: 603 - RNA, 21 nt, Artificial Sequence
  Synthetic polynucleotide
acacgcagacacagagacauu

SEQ ID NO: 604 - RNA, 21 nt, Artificial Sequence
  Synthetic polynucleotide
cacgcagacacagagacacuu

SEQ ID NO: 605 - RNA, 21 nt, Artificial Sequence
  Synthetic polynucleotide
acgcagacacagagacaccuu

SEQ ID NO: 606 - RNA, 21 nt, Artificial Sequence
  Synthetic polynucleotide
agugaggugacuggcauguuu

SEQ ID NO: 607 - RNA, 21 nt, Artificial Sequence
  Synthetic polynucleotide
cgcagacacagagacaccguu

SEQ ID NO: 608 - RNA, 21 nt, Artificial Sequence
  Synthetic polynucleotide
gcagacacagagacaccgguu

SEQ ID NO: 609 - RNA, 21 nt, Artificial Sequence
  Synthetic polynucleotide
cagacacagagacaccggguu

SEQ ID NO: 610 - RNA, 21 nt, Artificial Sequence
  Synthetic polynucleotide
agacacagagacaccgggguu

SEQ ID NO: 611 - RNA, 21 nt, Artificial Sequence
  Synthetic polynucleotide
gacacagagacaccggggcuu

SEQ ID NO: 612 - RNA, 21 nt, Artificial Sequence
  Synthetic polynucleotide
acacagagacaccggggccuu

SEQ ID NO: 613 - RNA, 21 nt, Artificial Sequence
  Synthetic polynucleotide
cacagagacaccggggcccuu

SEQ ID NO: 614 - RNA, 21 nt, Artificial Sequence
  Synthetic polynucleotide
acagagacaccggggcccauu

SEQ ID NO: 615 - RNA, 21 nt, Artificial Sequence
  Synthetic polynucleotide
cagagacaccggggcccaguu

SEQ ID NO: 616 - RNA, 21 nt, Artificial Sequence
  Synthetic polynucleotide
agagacaccggggcccagguu

SEQ ID NO: 617 - RNA, 21 nt, Artificial Sequence
  Synthetic polynucleotide
gugaggugacuggcauguguu

SEQ ID NO: 618 - RNA, 21 nt, Artificial Sequence
  Synthetic polynucleotide
gagacaccggggcccaggguu

SEQ ID NO: 619 - RNA, 21 nt, Artificial Sequence
  Synthetic polynucleotide
agacaccggggcccagggcuu

SEQ ID NO: 620 - RNA, 21 nt, Artificial Sequence
  Synthetic polynucleotide
gacaccggggcccagggccuu

SEQ ID NO: 621 - RNA, 21 nt, Artificial Sequence
  Synthetic polynucleotide
acaccggggcccagggcccuu

SEQ ID NO: 622 - RNA, 21 nt, Artificial Sequence
  Synthetic polynucleotide
caccggggcccagggcccuuu

SEQ ID NO: 623 - RNA, 21 nt, Artificial Sequence
  Synthetic polynucleotide
accggggcccagggcccucuu

SEQ ID NO: 624 - RNA, 21 nt, Artificial Sequence
  Synthetic polynucleotide
ccaaacggugcacggaagauu

SEQ ID NO: 625 - RNA, 21 nt, Artificial Sequence
  Synthetic polynucleotide
ccggggcccagggcccuccuu

SEQ ID NO: 626 - RNA, 21 nt, Artificial Sequence
  Synthetic polynucleotide
cggggcccagggcccuccuuu

SEQ ID NO: 627 - RNA, 21 nt, Artificial Sequence
  Synthetic polynucleotide
ggggcccagggcccuccuauu

SEQ ID NO: 628 - RNA, 21 nt, Artificial Sequence
  Synthetic polynucleotide
gggcccagggcccuccuauuu

SEQ ID NO: 629 - RNA, 21 nt, Artificial Sequence
  Synthetic polynucleotide
ugaggugacuggcauguguuu

SEQ ID NO: 630 - RNA, 21 nt, Artificial Sequence
  Synthetic polynucleotide
ggcccagggcccuccuauguu

SEQ ID NO: 631 - RNA, 21 nt, Artificial Sequence
  Synthetic polynucleotide
gcccagggcccuccuaugguu

SEQ ID NO: 632 - RNA, 21 nt, Artificial Sequence
  Synthetic polynucleotide
cccagggcccuccuauggauu

SEQ ID NO: 633 - RNA, 21 nt, Artificial Sequence
  Synthetic polynucleotide
ccagggcccuccuauggacuu

SEQ ID NO: 634 - RNA, 21 nt, Artificial Sequence
  Synthetic polynucleotide
cagggcccuccuauggaccuu

SEQ ID NO: 635 - RNA, 21 nt, Artificial Sequence
  Synthetic polynucleotide
agggcccuccuauggacccuu

SEQ ID NO: 636 - RNA, 21 nt, Artificial Sequence
  Synthetic polynucleotide
gggcccuccuauggacccuuu

SEQ ID NO: 637 - RNA, 21 nt, Artificial Sequence
  Synthetic polynucleotide
ggcccuccuauggacccuguu

SEQ ID NO: 638 - RNA, 21 nt, Artificial Sequence
  Synthetic polynucleotide
gcccuccuauggacccugcuu

SEQ ID NO: 639 - RNA, 21 nt, Artificial Sequence
  Synthetic polynucleotide
cccuccuauggacccugccuu

SEQ ID NO: 640 - RNA, 21 nt, Artificial Sequence
  Synthetic polynucleotide
gaggugacuggcauguguguu

SEQ ID NO: 641 - RNA, 21 nt, Artificial Sequence
  Synthetic polynucleotide
ccuccuauggacccugcccuu

SEQ ID NO: 642 - RNA, 21 nt, Artificial Sequence
  Synthetic polynucleotide
cuccuauggacccugcccguu

SEQ ID NO: 643 - RNA, 21 nt, Artificial Sequence
  Synthetic polynucleotide
uccuauggacccugcccgcuu

SEQ ID NO: 644 - RNA, 21 nt, Artificial Sequence
  Synthetic polynucleotide
ccuauggacccugcccgcuuu

SEQ ID NO: 645 - RNA, 21 nt, Artificial Sequence
  Synthetic polynucleotide
cuauggacccugcccgcucuu

SEQ ID NO: 646 - RNA, 21 nt, Artificial Sequence
  Synthetic polynucleotide
uauggacccugcccgcuccuu

SEQ ID NO: 647 - RNA, 21 nt, Artificial Sequence
  Synthetic polynucleotide
auggacccugcccgcucccuu

SEQ ID NO: 648 - RNA, 21 nt, Artificial Sequence
  Synthetic polynucleotide
uggacccugcccgcuccccuu

SEQ ID NO: 649 - RNA, 21 nt, Artificial Sequence
  Synthetic polynucleotide
ggacccugcccgcuccccuuu

SEQ ID NO: 650 - RNA, 21 nt, Artificial Sequence
  Synthetic polynucleotide
gacccugcccgcuccccucuu

SEQ ID NO: 651 - RNA, 21 nt, Artificial Sequence
  Synthetic polynucleotide
aggugacuggcaugugugguu

SEQ ID NO: 652 - RNA, 21 nt, Artificial Sequence
  Synthetic polynucleotide
acccugcccgcuccccuccuu

SEQ ID NO: 653 - RNA, 21 nt, Artificial Sequence
  Synthetic polynucleotide
cccugcccgcuccccucccuu

SEQ ID NO: 654 - RNA, 21 nt, Artificial Sequence
  Synthetic polynucleotide
ccugcccgcuccccucccauu

SEQ ID NO: 655 - RNA, 21 nt, Artificial Sequence
  Synthetic polynucleotide
cugcccgcuccccucccauuu

SEQ ID NO: 656 - RNA, 21 nt, Artificial Sequence
  Synthetic polynucleotide
ugcccgcuccccucccauuuu

SEQ ID NO: 657 - RNA, 21 nt, Artificial Sequence
  Synthetic polynucleotide
gcccgcuccccucccauuguu

SEQ ID NO: 658 - RNA, 21 nt, Artificial Sequence
  Synthetic polynucleotide
cccgcuccccucccauuguuu

SEQ ID NO: 659 - RNA, 21 nt, Artificial Sequence
  Synthetic polynucleotide
ccgcuccccucccauugucuu

SEQ ID NO: 660 - RNA, 21 nt, Artificial Sequence
  Synthetic polynucleotide
cgcuccccucccauuguccuu

SEQ ID NO: 661 - RNA, 21 nt, Artificial Sequence
  Synthetic polynucleotide
gcuccccucccauuguccauu

SEQ ID NO: 662 - RNA, 21 nt, Artificial Sequence
  Synthetic polynucleotide
cuccccucccauuguccacuu

SEQ ID NO: 663 - RNA, 21 nt, Artificial Sequence
  Synthetic polynucleotide
ggugacuggcauguguggguu

SEQ ID NO: 664 - RNA, 21 nt, Artificial Sequence
  Synthetic polynucleotide
uccccucccauuguccacguu

SEQ ID NO: 665 - RNA, 21 nt, Artificial Sequence
  Synthetic polynucleotide
ccccucccauuguccacgguu

SEQ ID NO: 666 - RNA, 21 nt, Artificial Sequence
  Synthetic polynucleotide
cccucccauuguccacggcuu

SEQ ID NO: 667 - RNA, 21 nt, Artificial Sequence
  Synthetic polynucleotide
ccucccauuguccacggcuuu

SEQ ID NO: 668 - RNA, 21 nt, Artificial Sequence
  Synthetic polynucleotide
cucccauuguccacggcuguu

SEQ ID NO: 669 - RNA, 21 nt, Artificial Sequence
  Synthetic polynucleotide
ucccauuguccacggcuguuu

SEQ ID NO: 670 - RNA, 21 nt, Artificial Sequence
  Synthetic polynucleotide
cccauuguccacggcugucuu

SEQ ID NO: 671 - RNA, 21 nt, Artificial Sequence
  Synthetic polynucleotide
ccauuguccacggcuguccuu

SEQ ID NO: 672 - RNA, 21 nt, Artificial Sequence
  Synthetic polynucleotide
cauuguccacggcuguccguu

SEQ ID NO: 673 - RNA, 21 nt, Artificial Sequence
  Synthetic polynucleotide
auuguccacggcuguccgcuu

SEQ ID NO: 674 - RNA, 21 nt, Artificial Sequence
  Synthetic polynucleotide
gugacuggcaugugugggguu

SEQ ID NO: 675 - RNA, 21 nt, Artificial Sequence
  Synthetic polynucleotide
uuguccacggcuguccgccuu

SEQ ID NO: 676 - RNA, 21 nt, Artificial Sequence
  Synthetic polynucleotide
uguccacggcuguccgcccuu

SEQ ID NO: 677 - RNA, 21 nt, Artificial Sequence
  Synthetic polynucleotide
guccacggcuguccgcccauu

SEQ ID NO: 678 - RNA, 21 nt, Artificial Sequence
  Synthetic polynucleotide
uccacggcuguccgcccacuu

SEQ ID NO: 679 - RNA, 21 nt, Artificial Sequence
  Synthetic polynucleotide
ccacggcuguccgcccaccuu

SEQ ID NO: 680 - RNA, 21 nt, Artificial Sequence
  Synthetic polynucleotide
cacggcuguccgcccacccuu

SEQ ID NO: 681 - RNA, 21 nt, Artificial Sequence
  Synthetic polynucleotide
acggcuguccgcccaccccuu

SEQ ID NO: 682 - RNA, 21 nt, Artificial Sequence
  Synthetic polynucleotide
cggcuguccgcccacccccuu

SEQ ID NO: 683 - RNA, 21 nt, Artificial Sequence
  Synthetic polynucleotide
ggcuguccgcccacccccauu

SEQ ID NO: 684 - RNA, 21 nt, Artificial Sequence
  Synthetic polynucleotide
gcuguccgcccacccccauuu

SEQ ID NO: 685 - RNA, 21 nt, Artificial Sequence
  Synthetic polynucleotide
ugacuggcauguguggggguu

SEQ ID NO: 686 - RNA, 21 nt, Artificial Sequence
  Synthetic polynucleotide
cuguccgcccacccccauuuu

SEQ ID NO: 687 - RNA, 21 nt, Artificial Sequence
  Synthetic polynucleotide
uguccgcccacccccauucuu

SEQ ID NO: 688 - RNA, 21 nt, Artificial Sequence
  Synthetic polynucleotide
guccgcccacccccauucuuu

SEQ ID NO: 689 - RNA, 21 nt, Artificial Sequence
  Synthetic polynucleotide
uccgcccacccccauucucuu

SEQ ID NO: 690 - RNA, 21 nt, Artificial Sequence
  Synthetic polynucleotide
ccgcccacccccauucuccuu

SEQ ID NO: 691 - RNA, 21 nt, Artificial Sequence
  Synthetic polynucleotide
cgcccacccccauucuccauu

SEQ ID NO: 692 - RNA, 21 nt, Artificial Sequence
  Synthetic polynucleotide
gcccacccccauucuccaauu

SEQ ID NO: 693 - RNA, 21 nt, Artificial Sequence
  Synthetic polynucleotide
cccacccccauucuccaaguu

SEQ ID NO: 694 - RNA, 21 nt, Artificial Sequence
  Synthetic polynucleotide
ccacccccauucuccaagcuu

SEQ ID NO: 695 - RNA, 21 nt, Artificial Sequence
  Synthetic polynucleotide
cacccccauucuccaagcuuu

SEQ ID NO: 696 - RNA, 21 nt, Artificial Sequence
  Synthetic polynucleotide
gacuggcaugugugggggcuu

SEQ ID NO: 697 - RNA, 21 nt, Artificial Sequence
  Synthetic polynucleotide
acccccauucuccaagcuuuu

SEQ ID NO: 698 - RNA, 21 nt, Artificial Sequence
  Synthetic polynucleotide
cccccauucuccaagcuucuu

SEQ ID NO: 699 - RNA, 21 nt, Artificial Sequence
  Synthetic polynucleotide
ccccauucuccaagcuucauu

SEQ ID NO: 700 - RNA, 21 nt, Artificial Sequence
  Synthetic polynucleotide
cccauucuccaagcuucaguu

SEQ ID NO: 701 - RNA, 21 nt, Artificial Sequence
  Synthetic polynucleotide
ccauucuccaagcuucagcuu

SEQ ID NO: 702 - RNA, 21 nt, Artificial Sequence
  Synthetic polynucleotide
cauucuccaagcuucagccuu

SEQ ID NO: 703 - RNA, 21 nt, Artificial Sequence
  Synthetic polynucleotide
auucuccaagcuucagcccuu

SEQ ID NO: 704 - RNA, 21 nt, Artificial Sequence
  Synthetic polynucleotide
uucuccaagcuucagccccuu

SEQ ID NO: 705 - RNA, 21 nt, Artificial Sequence
  Synthetic polynucleotide
ucuccaagcuucagcccccuu

SEQ ID NO: 706 - RNA, 21 nt, Artificial Sequence
  Synthetic polynucleotide
cuccaagcuucagcccccuuu

SEQ ID NO: 707 - RNA, 21 nt, Artificial Sequence
  Synthetic polynucleotide
acuggcaugugugggggcauu

SEQ ID NO: 708 - RNA, 21 nt, Artificial Sequence
  Synthetic polynucleotide
uccaagcuucagcccccucuu

SEQ ID NO: 709 - RNA, 21 nt, Artificial Sequence
  Synthetic polynucleotide
ccaagcuucagcccccuccuu

SEQ ID NO: 710 - RNA, 21 nt, Artificial Sequence
  Synthetic polynucleotide
caagcuucagcccccuccuuu

SEQ ID NO: 711 - RNA, 21 nt, Artificial Sequence
  Synthetic polynucleotide
aagcuucagcccccuccuuuu

SEQ ID NO: 712 - RNA, 21 nt, Artificial Sequence
  Synthetic polynucleotide
agcuucagcccccuccuuauu

SEQ ID NO: 713 - RNA, 21 nt, Artificial Sequence
  Synthetic polynucleotide
gcuucagcccccuccuuaguu

SEQ ID NO: 714 - RNA, 21 nt, Artificial Sequence
  Synthetic polynucleotide
cuucagcccccuccuuaguuu

SEQ ID NO: 715 - RNA, 21 nt, Artificial Sequence
  Synthetic polynucleotide
uucagcccccuccuuaguuuu

SEQ ID NO: 716 - RNA, 21 nt, Artificial Sequence
  Synthetic polynucleotide
ucagcccccuccuuaguucuu

SEQ ID NO: 717 - RNA, 21 nt, Artificial Sequence
  Synthetic polynucleotide
cagcccccuccuuaguucguu

SEQ ID NO: 718 - RNA, 21 nt, Artificial Sequence
  Synthetic polynucleotide
cuggcaugugugggggcaauu

SEQ ID NO: 719 - RNA, 21 nt, Artificial Sequence
  Synthetic polynucleotide
agcccccuccuuaguucgguu

SEQ ID NO: 720 - RNA, 21 nt, Artificial Sequence
  Synthetic polynucleotide
gcccccuccuuaguucggcuu

SEQ ID NO: 721 - RNA, 21 nt, Artificial Sequence
  Synthetic polynucleotide
cccccuccuuaguucggcauu

SEQ ID NO: 722 - RNA, 21 nt, Artificial Sequence
  Synthetic polynucleotide
ccccuccuuaguucggcauuu

SEQ ID NO: 723 - RNA, 21 nt, Artificial Sequence
  Synthetic polynucleotide
cccuccuuaguucggcaucuu

SEQ ID NO: 724 - RNA, 21 nt, Artificial Sequence
  Synthetic polynucleotide
ccuccuuaguucggcaucuuu

SEQ ID NO: 725 - RNA, 21 nt, Artificial Sequence
  Synthetic polynucleotide
cuccuuaguucggcaucuguu

SEQ ID NO: 726 - RNA, 21 nt, Artificial Sequence
  Synthetic polynucleotide
uccuuaguucggcaucugcuu

SEQ ID NO: 727 - RNA, 21 nt, Artificial Sequence
  Synthetic polynucleotide
ccuuaguucggcaucugcauu

SEQ ID NO: 728 - RNA, 21 nt, Artificial Sequence
  Synthetic polynucleotide
cuuaguucggcaucugcacuu

SEQ ID NO: 729 - RNA, 21 nt, Artificial Sequence
  Synthetic polynucleotide
uggcaugugugggggcaacuu

SEQ ID NO: 730 - RNA, 21 nt, Artificial Sequence
  Synthetic polynucleotide
uuaguucggcaucugcacauu

SEQ ID NO: 731 - RNA, 21 nt, Artificial Sequence
  Synthetic polynucleotide
uaguucggcaucugcacaguu

SEQ ID NO: 732 - RNA, 21 nt, Artificial Sequence
  Synthetic polynucleotide
aguucggcaucugcacagcuu

SEQ ID NO: 733 - RNA, 21 nt, Artificial Sequence
  Synthetic polynucleotide
guucggcaucugcacagcauu

SEQ ID NO: 734 - RNA, 21 nt, Artificial Sequence
  Synthetic polynucleotide
uucggcaucugcacagcacuu

SEQ ID NO: 735 - RNA, 21 nt, Artificial Sequence
  Synthetic polynucleotide
ucggcaucugcacagcacuuu

SEQ ID NO: 736 - RNA, 21 nt, Artificial Sequence
  Synthetic polynucleotide
caaacggugcacggaagaguu

SEQ ID NO: 737 - RNA, 21 nt, Artificial Sequence
  Synthetic polynucleotide
cggcaucugcacagcacuguu

SEQ ID NO: 738 - RNA, 21 nt, Artificial Sequence
  Synthetic polynucleotide
ggcaucugcacagcacugauu

SEQ ID NO: 739 - RNA, 21 nt, Artificial Sequence
  Synthetic polynucleotide
gcaucugcacagcacugaauu

SEQ ID NO: 740 - RNA, 21 nt, Artificial Sequence
  Synthetic polynucleotide
caucugcacagcacugaaguu

SEQ ID NO: 741 - RNA, 21 nt, Artificial Sequence
  Synthetic polynucleotide
ggcaugugugggggcaacauu

SEQ ID NO: 742 - RNA, 21 nt, Artificial Sequence
  Synthetic polynucleotide
aucugcacagcacugaagauu

SEQ ID NO: 743 - RNA, 21 nt, Artificial Sequence
  Synthetic polynucleotide
ucugcacagcacugaagaauu

SEQ ID NO: 744 - RNA, 21 nt, Artificial Sequence
  Synthetic polynucleotide
cugcacagcacugaagaacuu

SEQ ID NO: 745 - RNA, 21 nt, Artificial Sequence
  Synthetic polynucleotide
ugcacagcacugaagaaccuu

SEQ ID NO: 746 - RNA, 21 nt, Artificial Sequence
  Synthetic polynucleotide
gcacagcacugaagaaccuuu

SEQ ID NO: 747 - RNA, 21 nt, Artificial Sequence
  Synthetic polynucleotide
cacagcacugaagaaccuguu

SEQ ID NO: 748 - RNA, 21 nt, Artificial Sequence
  Synthetic polynucleotide
acagcacugaagaaccugguu

SEQ ID NO: 749 - RNA, 21 nt, Artificial Sequence
  Synthetic polynucleotide
cagcacugaagaaccuggguu

SEQ ID NO: 750 - RNA, 21 nt, Artificial Sequence
  Synthetic polynucleotide
agcacugaagaaccugggauu

SEQ ID NO: 751 - RNA, 21 nt, Artificial Sequence
  Synthetic polynucleotide
gcacugaagaaccugggaauu

SEQ ID NO: 752 - RNA, 21 nt, Artificial Sequence
  Synthetic polynucleotide
gcaugugugggggcaacacuu

SEQ ID NO: 753 - RNA, 21 nt, Artificial Sequence
  Synthetic polynucleotide
cacugaagaaccugggaauuu

SEQ ID NO: 754 - RNA, 21 nt, Artificial Sequence
  Synthetic polynucleotide
acugaagaaccugggaaucuu

SEQ ID NO: 755 - RNA, 21 nt, Artificial Sequence
  Synthetic polynucleotide
cugaagaaccugggaaucauu

SEQ ID NO: 756 - RNA, 21 nt, Artificial Sequence
  Synthetic polynucleotide
ugaagaaccugggaaucaguu

SEQ ID NO: 757 - RNA, 21 nt, Artificial Sequence
  Synthetic polynucleotide
gaagaaccugggaaucagauu

SEQ ID NO: 758 - RNA, 21 nt, Artificial Sequence
  Synthetic polynucleotide
aagaaccugggaaucagacuu

SEQ ID NO: 759 - RNA, 21 nt, Artificial Sequence
  Synthetic polynucleotide
agaaccugggaaucagaccuu

SEQ ID NO: 760 - RNA, 21 nt, Artificial Sequence
  Synthetic polynucleotide
gaaccugggaaucagacccuu

SEQ ID NO: 761 - RNA, 21 nt, Artificial Sequence
  Synthetic polynucleotide
aaccugggaaucagacccuuu

SEQ ID NO: 762 - RNA, 21 nt, Artificial Sequence
  Synthetic polynucleotide
accugggaaucagacccuguu

SEQ ID NO: 763 - RNA, 21 nt, Artificial Sequence
  Synthetic polynucleotide
caugugugggggcaacacguu

SEQ ID NO: 764 - RNA, 21 nt, Artificial Sequence
  Synthetic polynucleotide
ccugggaaucagacccugauu

SEQ ID NO: 765 - RNA, 21 nt, Artificial Sequence
  Synthetic polynucleotide
cugggaaucagacccugaguu

SEQ ID NO: 766 - RNA, 21 nt, Artificial Sequence
  Synthetic polynucleotide
ugggaaucagacccugagauu

SEQ ID NO: 767 - RNA, 21 nt, Artificial Sequence
  Synthetic polynucleotide
gggaaucagacccugagacuu

SEQ ID NO: 768 - RNA, 21 nt, Artificial Sequence
  Synthetic polynucleotide
ggaaucagacccugagaccuu

SEQ ID NO: 769 - RNA, 21 nt, Artificial Sequence
  Synthetic polynucleotide
gaaucagacccugagacccuu

SEQ ID NO: 770 - RNA, 21 nt, Artificial Sequence
  Synthetic polynucleotide
aaucagacccugagacccuuu

SEQ ID NO: 771 - RNA, 21 nt, Artificial Sequence
  Synthetic polynucleotide
aucagacccugagacccuguu

SEQ ID NO: 772 - RNA, 21 nt, Artificial Sequence
  Synthetic polynucleotide
ucagacccugagacccugauu

SEQ ID NO: 773 - RNA, 21 nt, Artificial Sequence
  Synthetic polynucleotide
cagacccugagacccugaguu

SEQ ID NO: 774 - RNA, 21 nt, Artificial Sequence
  Synthetic polynucleotide
augugugggggcaacacgauu

SEQ ID NO: 775 - RNA, 21 nt, Artificial Sequence
  Synthetic polynucleotide
agacccugagacccugagcuu

SEQ ID NO: 776 - RNA, 21 nt, Artificial Sequence
  Synthetic polynucleotide
gacccugagacccugagcauu

SEQ ID NO: 777 - RNA, 21 nt, Artificial Sequence
  Synthetic polynucleotide
acccugagacccugagcaauu

SEQ ID NO: 778 - RNA, 21 nt, Artificial Sequence
  Synthetic polynucleotide
cccugagacccugagcaauuu

SEQ ID NO: 779 - RNA, 21 nt, Artificial Sequence
  Synthetic polynucleotide
ccugagacccugagcaaucuu

SEQ ID NO: 780 - RNA, 21 nt, Artificial Sequence
  Synthetic polynucleotide
cugagacccugagcaauccuu

SEQ ID NO: 781 - RNA, 21 nt, Artificial Sequence
  Synthetic polynucleotide
ugagacccugagcaaucccuu

SEQ ID NO: 782 - RNA, 21 nt, Artificial Sequence
  Synthetic polynucleotide
gagacccugagcaaucccauu

SEQ ID NO: 783 - RNA, 21 nt, Artificial Sequence
  Synthetic polynucleotide
agacccugagcaaucccaguu

SEQ ID NO: 784 - RNA, 21 nt, Artificial Sequence
  Synthetic polynucleotide
gacccugagcaaucccagguu

SEQ ID NO: 785 - RNA, 21 nt, Artificial Sequence
  Synthetic polynucleotide
acccugagcaaucccagguuu

SEQ ID NO: 786 - RNA, 21 nt, Artificial Sequence
  Synthetic polynucleotide
ugugugggggcaacacgauuu

SEQ ID NO: 787 - RNA, 21 nt, Artificial Sequence
  Synthetic polynucleotide
cccugagcaaucccaggucuu

SEQ ID NO: 788 - RNA, 21 nt, Artificial Sequence
  Synthetic polynucleotide
ccugagcaaucccagguccuu

SEQ ID NO: 789 - RNA, 21 nt, Artificial Sequence
  Synthetic polynucleotide
cugagcaaucccagguccauu

SEQ ID NO: 790 - RNA, 21 nt, Artificial Sequence
  Synthetic polynucleotide
ugagcaaucccagguccaguu

SEQ ID NO: 791 - RNA, 21 nt, Artificial Sequence
  Synthetic polynucleotide
gagcaaucccagguccagcuu

SEQ ID NO: 792 - RNA, 21 nt, Artificial Sequence
  Synthetic polynucleotide
agcaaucccagguccagcguu

SEQ ID NO: 793 - RNA, 21 nt, Artificial Sequence
  Synthetic polynucleotide
gcaaucccagguccagcgcuu

SEQ ID NO: 794 - RNA, 21 nt, Artificial Sequence
  Synthetic polynucleotide
caaucccagguccagcgccuu

SEQ ID NO: 795 - RNA, 21 nt, Artificial Sequence
  Synthetic polynucleotide
aaucccagguccagcgccauu

SEQ ID NO: 796 - RNA, 21 nt, Artificial Sequence
  Synthetic polynucleotide
aucccagguccagcgccaguu

SEQ ID NO: 797 - RNA, 21 nt, Artificial Sequence
  Synthetic polynucleotide
gugugggggcaacacgauuuu

SEQ ID NO: 798 - RNA, 21 nt, Artificial Sequence
  Synthetic polynucleotide
ucccagguccagcgccagcuu

SEQ ID NO: 799 - RNA, 21 nt, Artificial Sequence
  Synthetic polynucleotide
cccagguccagcgccagccuu

SEQ ID NO: 800 - RNA, 21 nt, Artificial Sequence
  Synthetic polynucleotide
ccagguccagcgccagcccuu

SEQ ID NO: 801 - RNA, 21 nt, Artificial Sequence
  Synthetic polynucleotide
cagguccagcgccagcccuuu

SEQ ID NO: 802 - RNA, 21 nt, Artificial Sequence
  Synthetic polynucleotide
agguccagcgccagcccuauu

SEQ ID NO: 803 - RNA, 21 nt, Artificial Sequence
  Synthetic polynucleotide
gguccagcgccagcccuauuu

SEQ ID NO: 804 - RNA, 21 nt, Artificial Sequence
  Synthetic polynucleotide
guccagcgccagcccuaucuu

SEQ ID NO: 805 - RNA, 21 nt, Artificial Sequence
  Synthetic polynucleotide
uccagcgccagcccuaucauu

SEQ ID NO: 806 - RNA, 21 nt, Artificial Sequence
  Synthetic polynucleotide
ccagcgccagcccuaucauuu

SEQ ID NO: 807 - RNA, 21 nt, Artificial Sequence
  Synthetic polynucleotide
cagcgccagcccuaucauguu

SEQ ID NO: 808 - RNA, 21 nt, Artificial Sequence
  Synthetic polynucleotide
ugugggggcaacacgauucuu

SEQ ID NO: 809 - RNA, 21 nt, Artificial Sequence
  Synthetic polynucleotide
agcgccagcccuaucaugauu

SEQ ID NO: 810 - RNA, 21 nt, Artificial Sequence
  Synthetic polynucleotide
gcgccagcccuaucaugacuu

SEQ ID NO: 811 - RNA, 21 nt, Artificial Sequence
  Synthetic polynucleotide
cgccagcccuaucaugaccuu

SEQ ID NO: 812 - RNA, 21 nt, Artificial Sequence
  Synthetic polynucleotide
gccagcccuaucaugaccauu

SEQ ID NO: 813 - RNA, 21 nt, Artificial Sequence
  Synthetic polynucleotide
ccagcccuaucaugaccaauu

SEQ ID NO: 814 - RNA, 21 nt, Artificial Sequence
  Synthetic polynucleotide
cagcccuaucaugaccaaguu

SEQ ID NO: 815 - RNA, 21 nt, Artificial Sequence
  Synthetic polynucleotide
agcccuaucaugaccaagguu

SEQ ID NO: 816 - RNA, 21 nt, Artificial Sequence
  Synthetic polynucleotide
gcccuaucaugaccaaggauu

SEQ ID NO: 817 - RNA, 21 nt, Artificial Sequence
  Synthetic polynucleotide
cccuaucaugaccaaggaguu

SEQ ID NO: 818 - RNA, 21 nt, Artificial Sequence
  Synthetic polynucleotide
ccuaucaugaccaaggaguuu

SEQ ID NO: 819 - RNA, 21 nt, Artificial Sequence
  Synthetic polynucleotide
gugggggcaacacgauucuuu

SEQ ID NO: 820 - RNA, 21 nt, Artificial Sequence
  Synthetic polynucleotide
cuaucaugaccaaggaguauu

SEQ ID NO: 821 - RNA, 21 nt, Artificial Sequence
  Synthetic polynucleotide
uaucaugaccaaggaguauuu

SEQ ID NO: 822 - RNA, 21 nt, Artificial Sequence
  Synthetic polynucleotide
aucaugaccaaggaguaucuu

SEQ ID NO: 823 - RNA, 21 nt, Artificial Sequence
  Synthetic polynucleotide
ucaugaccaaggaguaucauu

SEQ ID NO: 824 - RNA, 21 nt, Artificial Sequence
  Synthetic polynucleotide
caugaccaaggaguaucaauu

SEQ ID NO: 825 - RNA, 21 nt, Artificial Sequence
  Synthetic polynucleotide
augaccaaggaguaucaaguu

SEQ ID NO: 826 - RNA, 21 nt, Artificial Sequence
  Synthetic polynucleotide
ugaccaaggaguaucaagauu

SEQ ID NO: 827 - RNA, 21 nt, Artificial Sequence
  Synthetic polynucleotide
gaccaaggaguaucaagacuu

SEQ ID NO: 828 - RNA, 21 nt, Artificial Sequence
  Synthetic polynucleotide
accaaggaguaucaagaccuu

SEQ ID NO: 829 - RNA, 21 nt, Artificial Sequence
  Synthetic polynucleotide
ccaaggaguaucaagaccuuu

SEQ ID NO: 830 - RNA, 21 nt, Artificial Sequence
  Synthetic polynucleotide
ugggggcaacacgauucucuu

SEQ ID NO: 831 - RNA, 21 nt, Artificial Sequence
  Synthetic polynucleotide
caaggaguaucaagaccuuuu

SEQ ID NO: 832 - RNA, 21 nt, Artificial Sequence
  Synthetic polynucleotide
aaggaguaucaagaccuucuu

SEQ ID NO: 833 - RNA, 21 nt, Artificial Sequence
  Synthetic polynucleotide
aggaguaucaagaccuucauu

SEQ ID NO: 834 - RNA, 21 nt, Artificial Sequence
  Synthetic polynucleotide
ggaguaucaagaccuucaguu

SEQ ID NO: 835 - RNA, 21 nt, Artificial Sequence
  Synthetic polynucleotide
gaguaucaagaccuucagcuu

SEQ ID NO: 836 - RNA, 21 nt, Artificial Sequence
  Synthetic polynucleotide
aguaucaagaccuucagcauu

SEQ ID NO: 837 - RNA, 21 nt, Artificial Sequence
  Synthetic polynucleotide
guaucaagaccuucagcauuu

SEQ ID NO: 838 - RNA, 21 nt, Artificial Sequence
  Synthetic polynucleotide
uaucaagaccuucagcaucuu

SEQ ID NO: 839 - RNA, 21 nt, Artificial Sequence
  Synthetic polynucleotide
aucaagaccuucagcaucuuu

SEQ ID NO: 840 - RNA, 21 nt, Artificial Sequence
  Synthetic polynucleotide
ucaagaccuucagcaucuguu

SEQ ID NO: 841 - RNA, 21 nt, Artificial Sequence
  Synthetic polynucleotide
gggggcaacacgauucuccuu

SEQ ID NO: 842 - RNA, 21 nt, Artificial Sequence
  Synthetic polynucleotide
caagaccuucagcaucugguu

SEQ ID NO: 843 - RNA, 21 nt, Artificial Sequence
  Synthetic polynucleotide
aagaccuucagcaucuggauu

SEQ ID NO: 844 - RNA, 21 nt, Artificial Sequence
  Synthetic polynucleotide
agaccuucagcaucuggacuu

SEQ ID NO: 845 - RNA, 21 nt, Artificial Sequence
  Synthetic polynucleotide
gaccuucagcaucuggacauu

SEQ ID NO: 846 - RNA, 21 nt, Artificial Sequence
  Synthetic polynucleotide
accuucagcaucuggacaauu

SEQ ID NO: 847 - RNA, 21 nt, Artificial Sequence
  Synthetic polynucleotide
ccuucagcaucuggacaauuu

SEQ ID NO: 848 - RNA, 21 nt, Artificial Sequence
  Synthetic polynucleotide
aaacggugcacggaagaguuu

SEQ ID NO: 849 - RNA, 21 nt, Artificial Sequence
  Synthetic polynucleotide
cuucagcaucuggacaauguu

SEQ ID NO: 850 - RNA, 21 nt, Artificial Sequence
  Synthetic polynucleotide
uucagcaucuggacaaugauu

SEQ ID NO: 851 - RNA, 21 nt, Artificial Sequence
  Synthetic polynucleotide
ucagcaucuggacaaugaguu

SEQ ID NO: 852 - RNA, 21 nt, Artificial Sequence
  Synthetic polynucleotide
cagcaucuggacaaugagguu

SEQ ID NO: 853 - RNA, 21 nt, Artificial Sequence
  Synthetic polynucleotide
ggggcaacacgauucuccuuu

SEQ ID NO: 854 - RNA, 21 nt, Artificial Sequence
  Synthetic polynucleotide
agcaucuggacaaugaggauu

SEQ ID NO: 855 - RNA, 21 nt, Artificial Sequence
  Synthetic polynucleotide
gcaucuggacaaugaggaguu

SEQ ID NO: 856 - RNA, 21 nt, Artificial Sequence
  Synthetic polynucleotide
caucuggacaaugaggagauu

SEQ ID NO: 857 - RNA, 21 nt, Artificial Sequence
  Synthetic polynucleotide
aucuggacaaugaggagaguu

SEQ ID NO: 858 - RNA, 21 nt, Artificial Sequence
  Synthetic polynucleotide
ucuggacaaugaggagaguuu

SEQ ID NO: 859 - RNA, 21 nt, Artificial Sequence
  Synthetic polynucleotide
cuggacaaugaggagaguguu

SEQ ID NO: 860 - RNA, 21 nt, Artificial Sequence
  Synthetic polynucleotide
uggacaaugaggagagugauu

SEQ ID NO: 861 - RNA, 21 nt, Artificial Sequence
  Synthetic polynucleotide
ggacaaugaggagagugacuu

SEQ ID NO: 862 - RNA, 21 nt, Artificial Sequence
  Synthetic polynucleotide
gacaaugaggagagugaccuu

SEQ ID NO: 863 - RNA, 21 nt, Artificial Sequence
  Synthetic polynucleotide
acaaugaggagagugaccauu

SEQ ID NO: 864 - RNA, 21 nt, Artificial Sequence
  Synthetic polynucleotide
gggcaacacgauucuccucuu

SEQ ID NO: 865 - RNA, 21 nt, Artificial Sequence
  Synthetic polynucleotide
caaugaggagagugaccacuu

SEQ ID NO: 866 - RNA, 21 nt, Artificial Sequence
  Synthetic polynucleotide
aaugaggagagugaccaccuu

SEQ ID NO: 867 - RNA, 21 nt, Artificial Sequence
  Synthetic polynucleotide
augaggagagugaccaccauu

SEQ ID NO: 868 - RNA, 21 nt, Artificial Sequence
  Synthetic polynucleotide
ugaggagagugaccaccauuu

SEQ ID NO: 869 - RNA, 21 nt, Artificial Sequence
  Synthetic polynucleotide
gaggagagugaccaccaucuu

SEQ ID NO: 870 - RNA, 21 nt, Artificial Sequence
  Synthetic polynucleotide
aggagagugaccaccaucauu

SEQ ID NO: 871 - RNA, 21 nt, Artificial Sequence
  Synthetic polynucleotide
ggagagugaccaccaucaguu

SEQ ID NO: 872 - RNA, 21 nt, Artificial Sequence
  Synthetic polynucleotide
gagagugaccaccaucagcuu

SEQ ID NO: 873 - RNA, 21 nt, Artificial Sequence
  Synthetic polynucleotide
agagugaccaccaucagcuuu

SEQ ID NO: 874 - RNA, 21 nt, Artificial Sequence
  Synthetic polynucleotide
gagugaccaccaucagcucuu

SEQ ID NO: 875 - RNA, 21 nt, Artificial Sequence
  Synthetic polynucleotide
ggcaacacgauucuccuccuu

SEQ ID NO: 876 - RNA, 21 nt, Artificial Sequence
  Synthetic polynucleotide
agugaccaccaucagcucauu

SEQ ID NO: 877 - RNA, 21 nt, Artificial Sequence
  Synthetic polynucleotide
gugaccaccaucagcucaguu

SEQ ID NO: 878 - RNA, 21 nt, Artificial Sequence
  Synthetic polynucleotide
ugaccaccaucagcucagauu

SEQ ID NO: 879 - RNA, 21 nt, Artificial Sequence
  Synthetic polynucleotide
gaccaccaucagcucagaauu

SEQ ID NO: 880 - RNA, 21 nt, Artificial Sequence
  Synthetic polynucleotide
accaccaucagcucagaaauu

SEQ ID NO: 881 - RNA, 21 nt, Artificial Sequence
  Synthetic polynucleotide
ccaccaucagcucagaaaauu

SEQ ID NO: 882 - RNA, 21 nt, Artificial Sequence
  Synthetic polynucleotide
caccaucagcucagaaaaguu

SEQ ID NO: 883 - RNA, 21 nt, Artificial Sequence
  Synthetic polynucleotide
accaucagcucagaaaagguu

SEQ ID NO: 884 - RNA, 21 nt, Artificial Sequence
  Synthetic polynucleotide
ccaucagcucagaaaaggguu

SEQ ID NO: 885 - RNA, 21 nt, Artificial Sequence
  Synthetic polynucleotide
caucagcucagaaaagggcuu

SEQ ID NO: 886 - RNA, 21 nt, Artificial Sequence
  Synthetic polynucleotide
gcaacacgauucuccucccuu

SEQ ID NO: 887 - RNA, 21 nt, Artificial Sequence
  Synthetic polynucleotide
aucagcucagaaaagggccuu

SEQ ID NO: 888 - RNA, 21 nt, Artificial Sequence
  Synthetic polynucleotide
ucagcucagaaaagggccauu

SEQ ID NO: 889 - RNA, 21 nt, Artificial Sequence
  Synthetic polynucleotide
cagcucagaaaagggccacuu

SEQ ID NO: 890 - RNA, 21 nt, Artificial Sequence
  Synthetic polynucleotide
agcucagaaaagggccaccuu

SEQ ID NO: 891 - RNA, 21 nt, Artificial Sequence
  Synthetic polynucleotide
gcucagaaaagggccaccuuu

SEQ ID NO: 892 - RNA, 21 nt, Artificial Sequence
  Synthetic polynucleotide
cucagaaaagggccaccucuu

SEQ ID NO: 893 - RNA, 21 nt, Artificial Sequence
  Synthetic polynucleotide
ucagaaaagggccaccuccuu

SEQ ID NO: 894 - RNA, 21 nt, Artificial Sequence
  Synthetic polynucleotide
cagaaaagggccaccuccuuu

SEQ ID NO: 895 - RNA, 21 nt, Artificial Sequence
  Synthetic polynucleotide
agaaaagggccaccuccucuu

SEQ ID NO: 896 - RNA, 21 nt, Artificial Sequence
  Synthetic polynucleotide
gaaaagggccaccuccuccuu

SEQ ID NO: 897 - RNA, 21 nt, Artificial Sequence
  Synthetic polynucleotide
caacacgauucuccucccuuu

SEQ ID NO: 898 - RNA, 21 nt, Artificial Sequence
  Synthetic polynucleotide
aaaagggccaccuccucccuu

SEQ ID NO: 899 - RNA, 21 nt, Artificial Sequence
  Synthetic polynucleotide
aaagggccaccuccuccccuu

SEQ ID NO: 900 - RNA, 21 nt, Artificial Sequence
  Synthetic polynucleotide
aagggccaccuccuccccauu

SEQ ID NO: 901 - RNA, 21 nt, Artificial Sequence
  Synthetic polynucleotide
agggccaccuccuccccaguu

SEQ ID NO: 902 - RNA, 21 nt, Artificial Sequence
  Synthetic polynucleotide
gggccaccuccuccccagcuu

SEQ ID NO: 903 - RNA, 21 nt, Artificial Sequence
  Synthetic polynucleotide
ggccaccuccuccccagccuu

SEQ ID NO: 904 - RNA, 21 nt, Artificial Sequence
  Synthetic polynucleotide
gccaccuccuccccagcccuu

SEQ ID NO: 905 - RNA, 21 nt, Artificial Sequence
  Synthetic polynucleotide
ccaccuccuccccagccccuu

SEQ ID NO: 906 - RNA, 21 nt, Artificial Sequence
  Synthetic polynucleotide
caccuccuccccagccccuuu

SEQ ID NO: 907 - RNA, 21 nt, Artificial Sequence
  Synthetic polynucleotide
accuccuccccagccccucuu

SEQ ID NO: 908 - RNA, 21 nt, Artificial Sequence
  Synthetic polynucleotide
ccuccuccccagccccuccuu

SEQ ID NO: 909 - RNA, 21 nt, Artificial Sequence
  Synthetic polynucleotide
aacacgauucuccucccuguu

SEQ ID NO: 910 - RNA, 21 nt, Artificial Sequence
  Synthetic polynucleotide
cuccuccccagccccuccuuu

SEQ ID NO: 911 - RNA, 21 nt, Artificial Sequence
  Synthetic polynucleotide
uccuccccagccccuccuguu

SEQ ID NO: 912 - RNA, 21 nt, Artificial Sequence
  Synthetic polynucleotide
ccuccccagccccuccugcuu

SEQ ID NO: 913 - RNA, 21 nt, Artificial Sequence
  Synthetic polynucleotide
cuccccagccccuccugcauu

SEQ ID NO: 914 - RNA, 21 nt, Artificial Sequence
  Synthetic polynucleotide
uccccagccccuccugcaguu

SEQ ID NO: 915 - RNA, 21 nt, Artificial Sequence
  Synthetic polynucleotide
ccccagccccuccugcagcuu

SEQ ID NO: 916 - RNA, 21 nt, Artificial Sequence
  Synthetic polynucleotide
cccagccccuccugcagcguu

SEQ ID NO: 917 - RNA, 21 nt, Artificial Sequence
  Synthetic polynucleotide
ccagccccuccugcagcguuu

SEQ ID NO: 918 - RNA, 21 nt, Artificial Sequence
  Synthetic polynucleotide
cagccccuccugcagcgucuu

SEQ ID NO: 919 - RNA, 21 nt, Artificial Sequence
  Synthetic polynucleotide
agccccuccugcagcgucuuu

SEQ ID NO: 920 - RNA, 21 nt, Artificial Sequence
  Synthetic polynucleotide
acacgauucuccucccugguu

SEQ ID NO: 921 - RNA, 21 nt, Artificial Sequence
  Synthetic polynucleotide
gccccuccugcagcgucucuu

SEQ ID NO: 922 - RNA, 21 nt, Artificial Sequence
  Synthetic polynucleotide
ccccuccugcagcgucucuuu

SEQ ID NO: 923 - RNA, 21 nt, Artificial Sequence
  Synthetic polynucleotide
cccuccugcagcgucucuguu

SEQ ID NO: 924 - RNA, 21 nt, Artificial Sequence
  Synthetic polynucleotide
ccuccugcagcgucucugcuu

SEQ ID NO: 925 - RNA, 21 nt, Artificial Sequence
  Synthetic polynucleotide
cuccugcagcgucucugcuuu

SEQ ID NO: 926 - RNA, 21 nt, Artificial Sequence
  Synthetic polynucleotide
uccugcagcgucucugcucuu

SEQ ID NO: 927 - RNA, 21 nt, Artificial Sequence
  Synthetic polynucleotide
ccugcagcgucucugcuccuu

SEQ ID NO: 928 - RNA, 21 nt, Artificial Sequence
  Synthetic polynucleotide
cugcagcgucucugcuccguu

SEQ ID NO: 929 - RNA, 21 nt, Artificial Sequence
  Synthetic polynucleotide
ugcagcgucucugcuccgguu

SEQ ID NO: 930 - RNA, 21 nt, Artificial Sequence
  Synthetic polynucleotide
gcagcgucucugcuccggauu

SEQ ID NO: 931 - RNA, 21 nt, Artificial Sequence
  Synthetic polynucleotide
cacgauucuccucccuggguu

SEQ ID NO: 932 - RNA, 21 nt, Artificial Sequence
  Synthetic polynucleotide
cagcgucucugcuccggacuu

SEQ ID NO: 933 - RNA, 21 nt, Artificial Sequence
  Synthetic polynucleotide
agcgucucugcuccggaccuu

SEQ ID NO: 934 - RNA, 21 nt, Artificial Sequence
  Synthetic polynucleotide
gcgucucugcuccggaccuuu

SEQ ID NO: 935 - RNA, 21 nt, Artificial Sequence
  Synthetic polynucleotide
cgucucugcuccggaccucuu

SEQ ID NO: 936 - RNA, 21 nt, Artificial Sequence
  Synthetic polynucleotide
gucucugcuccggaccucguu

SEQ ID NO: 937 - RNA, 21 nt, Artificial Sequence
  Synthetic polynucleotide
ucucugcuccggaccucgcuu

SEQ ID NO: 938 - RNA, 21 nt, Artificial Sequence
  Synthetic polynucleotide
cucugcuccggaccucgccuu

SEQ ID NO: 939 - RNA, 21 nt, Artificial Sequence
  Synthetic polynucleotide
ucugcuccggaccucgccuuu

SEQ ID NO: 940 - RNA, 21 nt, Artificial Sequence
  Synthetic polynucleotide
cugcuccggaccucgccucuu

SEQ ID NO: 941 - RNA, 21 nt, Artificial Sequence
  Synthetic polynucleotide
ugcuccggaccucgccuccuu

SEQ ID NO: 942 - RNA, 21 nt, Artificial Sequence
  Synthetic polynucleotide
acgauucuccucccugggguu

SEQ ID NO: 943 - RNA, 21 nt, Artificial Sequence
  Synthetic polynucleotide
gcuccggaccucgccuccuuu

SEQ ID NO: 944 - RNA, 21 nt, Artificial Sequence
  Synthetic polynucleotide
cuccggaccucgccuccucuu

SEQ ID NO: 945 - RNA, 21 nt, Artificial Sequence
  Synthetic polynucleotide
uccggaccucgccuccuccuu

SEQ ID NO: 946 - RNA, 21 nt, Artificial Sequence
  Synthetic polynucleotide
ccggaccucgccuccuccuuu

SEQ ID NO: 947 - RNA, 21 nt, Artificial Sequence
  Synthetic polynucleotide
cggaccucgccuccuccuguu

SEQ ID NO: 948 - RNA, 21 nt, Artificial Sequence
  Synthetic polynucleotide
ggaccucgccuccuccugcuu

SEQ ID NO: 949 - RNA, 21 nt, Artificial Sequence
  Synthetic polynucleotide
gaccucgccuccuccugcuuu

SEQ ID NO: 950 - RNA, 21 nt, Artificial Sequence
  Synthetic polynucleotide
accucgccuccuccugcucuu

SEQ ID NO: 951 - RNA, 21 nt, Artificial Sequence
  Synthetic polynucleotide
ccucgccuccuccugcucuuu

SEQ ID NO: 952 - RNA, 21 nt, Artificial Sequence
  Synthetic polynucleotide
cucgccuccuccugcucucuu

SEQ ID NO: 953 - RNA, 21 nt, Artificial Sequence
  Synthetic polynucleotide
cgauucuccucccuggggauu

SEQ ID NO: 954 - RNA, 21 nt, Artificial Sequence
  Synthetic polynucleotide
ucgccuccuccugcucuccuu

SEQ ID NO: 955 - RNA, 21 nt, Artificial Sequence
  Synthetic polynucleotide
cgccuccuccugcucucccuu

SEQ ID NO: 956 - RNA, 21 nt, Artificial Sequence
  Synthetic polynucleotide
gccuccuccugcucucccuuu

SEQ ID NO: 957 - RNA, 21 nt, Artificial Sequence
  Synthetic polynucleotide
ccuccuccugcucucccuguu

SEQ ID NO: 958 - RNA, 21 nt, Artificial Sequence
  Synthetic polynucleotide
cuccuccugcucucccugguu

SEQ ID NO: 959 - RNA, 21 nt, Artificial Sequence
  Synthetic polynucleotide
uccuccugcucucccuggguu

SEQ ID NO: 960 - RNA, 21 nt, Artificial Sequence
  Synthetic polynucleotide
aacggugcacggaagaguguu

SEQ ID NO: 961 - RNA, 21 nt, Artificial Sequence
  Synthetic polynucleotide
ccuccugcucucccugggcuu

SEQ ID NO: 962 - RNA, 21 nt, Artificial Sequence
  Synthetic polynucleotide
cuccugcucucccugggccuu

SEQ ID NO: 963 - RNA, 21 nt, Artificial Sequence
  Synthetic polynucleotide
uccugcucucccugggccuuu

SEQ ID NO: 964 - RNA, 21 nt, Artificial Sequence
  Synthetic polynucleotide
ccugcucucccugggccucuu

SEQ ID NO: 965 - RNA, 21 nt, Artificial Sequence
  Synthetic polynucleotide
gauucuccucccuggggaguu

SEQ ID NO: 966 - RNA, 21 nt, Artificial Sequence
  Synthetic polynucleotide
cugcucucccugggccucauu

SEQ ID NO: 967 - RNA, 21 nt, Artificial Sequence
  Synthetic polynucleotide
ugcucucccugggccucaguu

SEQ ID NO: 968 - RNA, 21 nt, Artificial Sequence
  Synthetic polynucleotide
gcucucccugggccucagcuu

SEQ ID NO: 969 - RNA, 21 nt, Artificial Sequence
  Synthetic polynucleotide
cucucccugggccucagccuu

SEQ ID NO: 970 - RNA, 21 nt, Artificial Sequence
  Synthetic polynucleotide
ucucccugggccucagccuuu

SEQ ID NO: 971 - RNA, 21 nt, Artificial Sequence
  Synthetic polynucleotide
cucccugggccucagccucuu

SEQ ID NO: 972 - RNA, 21 nt, Artificial Sequence
  Synthetic polynucleotide
ucccugggccucagccuccuu

SEQ ID NO: 973 - RNA, 21 nt, Artificial Sequence
  Synthetic polynucleotide
cccugggccucagccuccuuu

SEQ ID NO: 974 - RNA, 21 nt, Artificial Sequence
  Synthetic polynucleotide
ccugggccucagccuccuguu

SEQ ID NO: 975 - RNA, 21 nt, Artificial Sequence
  Synthetic polynucleotide
cugggccucagccuccugcuu

SEQ ID NO: 976 - RNA, 21 nt, Artificial Sequence
  Synthetic polynucleotide
auucuccucccuggggagcuu

SEQ ID NO: 977 - RNA, 21 nt, Artificial Sequence
  Synthetic polynucleotide
ugggccucagccuccugcuuu

SEQ ID NO: 978 - RNA, 21 nt, Artificial Sequence
  Synthetic polynucleotide
gggccucagccuccugcuguu

SEQ ID NO: 979 - RNA, 21 nt, Artificial Sequence
  Synthetic polynucleotide
ggccucagccuccugcugcuu

SEQ ID NO: 980 - RNA, 21 nt, Artificial Sequence
  Synthetic polynucleotide
gccucagccuccugcugcuuu

SEQ ID NO: 981 - RNA, 21 nt, Artificial Sequence
  Synthetic polynucleotide
ccucagccuccugcugcuuuu

SEQ ID NO: 982 - RNA, 21 nt, Artificial Sequence
  Synthetic polynucleotide
cucagccuccugcugcuuguu

SEQ ID NO: 983 - RNA, 21 nt, Artificial Sequence
  Synthetic polynucleotide
ucagccuccugcugcuuguuu

SEQ ID NO: 984 - RNA, 21 nt, Artificial Sequence
  Synthetic polynucleotide
cagccuccugcugcuuguguu

SEQ ID NO: 985 - RNA, 21 nt, Artificial Sequence
  Synthetic polynucleotide
agccuccugcugcuugugguu

SEQ ID NO: 986 - RNA, 21 nt, Artificial Sequence
  Synthetic polynucleotide
gccuccugcugcuugugguuu

SEQ ID NO: 987 - RNA, 21 nt, Artificial Sequence
  Synthetic polynucleotide
uucuccucccuggggagcauu

SEQ ID NO: 988 - RNA, 21 nt, Artificial Sequence
  Synthetic polynucleotide
ccuccugcugcuugugguuuu

SEQ ID NO: 989 - RNA, 21 nt, Artificial Sequence
  Synthetic polynucleotide
cuccugcugcuugugguuguu

SEQ ID NO: 990 - RNA, 21 nt, Artificial Sequence
  Synthetic polynucleotide
uccugcugcuugugguuguuu

SEQ ID NO: 991 - RNA, 21 nt, Artificial Sequence
  Synthetic polynucleotide
ccugcugcuugugguugucuu

SEQ ID NO: 992 - RNA, 21 nt, Artificial Sequence
  Synthetic polynucleotide
cugcugcuugugguugucuuu

SEQ ID NO: 993 - RNA, 21 nt, Artificial Sequence
  Synthetic polynucleotide
ugcugcuugugguugucuguu

SEQ ID NO: 994 - RNA, 21 nt, Artificial Sequence
  Synthetic polynucleotide
gcugcuugugguugucuguuu

SEQ ID NO: 995 - RNA, 21 nt, Artificial Sequence
  Synthetic polynucleotide
cugcuugugguugucuguguu

SEQ ID NO: 996 - RNA, 21 nt, Artificial Sequence
  Synthetic polynucleotide
ugcuugugguugucuguguuu

SEQ ID NO: 997 - RNA, 21 nt, Artificial Sequence
  Synthetic polynucleotide
gcuugugguugucuguguguu

SEQ ID NO: 998 - RNA, 21 nt, Artificial Sequence
  Synthetic polynucleotide
ucuccucccuggggagcaguu

SEQ ID NO: 999 - RNA, 21 nt, Artificial Sequence
  Synthetic polynucleotide
cuugugguugucugugugauu

SEQ ID NO: 1000 - RNA, 21 nt, Artificial Sequence
  Synthetic polynucleotide
uugugguugucugugugauuu

SEQ ID NO: 1001 - RNA, 21 nt, Artificial Sequence
  Synthetic polynucleotide
ugugguugucugugugaucuu

SEQ ID NO: 1002 - RNA, 21 nt, Artificial Sequence
  Synthetic polynucleotide
gugguugucugugugaucguu

SEQ ID NO: 1003 - RNA, 21 nt, Artificial Sequence
  Synthetic polynucleotide
ugguugucugugugaucgguu

SEQ ID NO: 1004 - RNA, 21 nt, Artificial Sequence
  Synthetic polynucleotide
gguugucugugugaucggauu

SEQ ID NO: 1005 - RNA, 21 nt, Artificial Sequence
  Synthetic polynucleotide
guugucugugugaucggauuu

SEQ ID NO: 1006 - RNA, 21 nt, Artificial Sequence
  Synthetic polynucleotide
uugucugugugaucggaucuu

SEQ ID NO: 1007 - RNA, 21 nt, Artificial Sequence
  Synthetic polynucleotide
ugucugugugaucggauccuu

SEQ ID NO: 1008 - RNA, 21 nt, Artificial Sequence
  Synthetic polynucleotide
gucugugugaucggaucccuu

SEQ ID NO: 1009 - RNA, 21 nt, Artificial Sequence
  Synthetic polynucleotide
cuccucccuggggagcagauu

SEQ ID NO: 1010 - RNA, 21 nt, Artificial Sequence
  Synthetic polynucleotide
ucugugugaucggaucccauu

SEQ ID NO: 1011 - RNA, 21 nt, Artificial Sequence
  Synthetic polynucleotide
cugugugaucggaucccaauu

SEQ ID NO: 1012 - RNA, 21 nt, Artificial Sequence
  Synthetic polynucleotide
ugugugaucggaucccaaauu

SEQ ID NO: 1013 - RNA, 21 nt, Artificial Sequence
  Synthetic polynucleotide
gugugaucggaucccaaaauu

SEQ ID NO: 1014 - RNA, 21 nt, Artificial Sequence
  Synthetic polynucleotide
ugugaucggaucccaaaacuu

SEQ ID NO: 1015 - RNA, 21 nt, Artificial Sequence
  Synthetic polynucleotide
gugaucggaucccaaaacuuu

SEQ ID NO: 1016 - RNA, 21 nt, Artificial Sequence
  Synthetic polynucleotide
ugaucggaucccaaaacucuu

SEQ ID NO: 1017 - RNA, 21 nt, Artificial Sequence
  Synthetic polynucleotide
gaucggaucccaaaacuccuu

SEQ ID NO: 1018 - RNA, 21 nt, Artificial Sequence
  Synthetic polynucleotide
aucggaucccaaaacucccuu

SEQ ID NO: 1019 - RNA, 21 nt, Artificial Sequence
  Synthetic polynucleotide
ucggaucccaaaacucccauu

SEQ ID NO: 1020 - RNA, 21 nt, Artificial Sequence
  Synthetic polynucleotide
uccucccuggggagcagaguu

SEQ ID NO: 1021 - RNA, 21 nt, Artificial Sequence
  Synthetic polynucleotide
cggaucccaaaacucccaguu

SEQ ID NO: 1022 - RNA, 21 nt, Artificial Sequence
  Synthetic polynucleotide
ggaucccaaaacucccagcuu

SEQ ID NO: 1023 - RNA, 21 nt, Artificial Sequence
  Synthetic polynucleotide
gaucccaaaacucccagcuuu

SEQ ID NO: 1024 - RNA, 21 nt, Artificial Sequence
  Synthetic polynucleotide
aucccaaaacucccagcuguu

SEQ ID NO: 1025 - RNA, 21 nt, Artificial Sequence
  Synthetic polynucleotide
ucccaaaacucccagcugcuu

SEQ ID NO: 1026 - RNA, 21 nt, Artificial Sequence
  Synthetic polynucleotide
cccaaaacucccagcugcauu

SEQ ID NO: 1027 - RNA, 21 nt, Artificial Sequence
  Synthetic polynucleotide
ccaaaacucccagcugcaguu

SEQ ID NO: 1028 - RNA, 21 nt, Artificial Sequence
  Synthetic polynucleotide
caaaacucccagcugcagguu

SEQ ID NO: 1029 - RNA, 21 nt, Artificial Sequence
  Synthetic polynucleotide
aaaacucccagcugcaggauu

SEQ ID NO: 1030 - RNA, 21 nt, Artificial Sequence
  Synthetic polynucleotide
aaacucccagcugcaggaguu

SEQ ID NO: 1031 - RNA, 21 nt, Artificial Sequence
  Synthetic polynucleotide
ccucccuggggagcagagcuu

SEQ ID NO: 1032 - RNA, 21 nt, Artificial Sequence
  Synthetic polynucleotide
aacucccagcugcaggagguu

SEQ ID NO: 1033 - RNA, 21 nt, Artificial Sequence
  Synthetic polynucleotide
acucccagcugcaggaggauu

SEQ ID NO: 1034 - RNA, 21 nt, Artificial Sequence
  Synthetic polynucleotide
cucccagcugcaggaggaguu

SEQ ID NO: 1035 - RNA, 21 nt, Artificial Sequence
  Synthetic polynucleotide
ucccagcugcaggaggagcuu

SEQ ID NO: 1036 - RNA, 21 nt, Artificial Sequence
  Synthetic polynucleotide
cccagcugcaggaggagcuuu

SEQ ID NO: 1037 - RNA, 21 nt, Artificial Sequence
  Synthetic polynucleotide
ccagcugcaggaggagcuguu

SEQ ID NO: 1038 - RNA, 21 nt, Artificial Sequence
  Synthetic polynucleotide
cagcugcaggaggagcugcuu

SEQ ID NO: 1039 - RNA, 21 nt, Artificial Sequence
  Synthetic polynucleotide
agcugcaggaggagcugcguu

SEQ ID NO: 1040 - RNA, 21 nt, Artificial Sequence
  Synthetic polynucleotide
gcugcaggaggagcugcgguu

SEQ ID NO: 1041 - RNA, 21 nt, Artificial Sequence
  Synthetic polynucleotide
cugcaggaggagcugcggguu

SEQ ID NO: 1042 - RNA, 21 nt, Artificial Sequence
  Synthetic polynucleotide
ugcaggaggagcugcgggguu

SEQ ID NO: 1043 - RNA, 21 nt, Artificial Sequence
  Synthetic polynucleotide
cucccuggggagcagagcauu

SEQ ID NO: 1044 - RNA, 21 nt, Artificial Sequence
  Synthetic polynucleotide
gcaggaggagcugcggggcuu

SEQ ID NO: 1045 - RNA, 21 nt, Artificial Sequence
  Synthetic polynucleotide
caggaggagcugcggggccuu

SEQ ID NO: 1046 - RNA, 21 nt, Artificial Sequence
  Synthetic polynucleotide
aggaggagcugcggggccuuu

SEQ ID NO: 1047 - RNA, 21 nt, Artificial Sequence
  Synthetic polynucleotide
ggaggagcugcggggccuguu

SEQ ID NO: 1048 - RNA, 21 nt, Artificial Sequence
  Synthetic polynucleotide
gaggagcugcggggccugauu

SEQ ID NO: 1049 - RNA, 21 nt, Artificial Sequence
  Synthetic polynucleotide
aggagcugcggggccugaguu

SEQ ID NO: 1050 - RNA, 21 nt, Artificial Sequence
  Synthetic polynucleotide
ggagcugcggggccugagauu

SEQ ID NO: 1051 - RNA, 21 nt, Artificial Sequence
  Synthetic polynucleotide
gagcugcggggccugagaguu

SEQ ID NO: 1052 - RNA, 21 nt, Artificial Sequence
  Synthetic polynucleotide
agcugcggggccugagagauu

SEQ ID NO: 1053 - RNA, 21 nt, Artificial Sequence
  Synthetic polynucleotide
gcugcggggccugagagaguu

SEQ ID NO: 1054 - RNA, 21 nt, Artificial Sequence
  Synthetic polynucleotide
ucccuggggagcagagcaguu

SEQ ID NO: 1055 - RNA, 21 nt, Artificial Sequence
  Synthetic polynucleotide
cugcggggccugagagagauu

SEQ ID NO: 1056 - RNA, 21 nt, Artificial Sequence
  Synthetic polynucleotide
ugcggggccugagagagacuu

SEQ ID NO: 1057 - RNA, 21 nt, Artificial Sequence
  Synthetic polynucleotide
gcggggccugagagagacguu

SEQ ID NO: 1058 - RNA, 21 nt, Artificial Sequence
  Synthetic polynucleotide
cggggccugagagagacguuu

SEQ ID NO: 1059 - RNA, 21 nt, Artificial Sequence
  Synthetic polynucleotide
ggggccugagagagacguuuu

SEQ ID NO: 1060 - RNA, 21 nt, Artificial Sequence
  Synthetic polynucleotide
gggccugagagagacguucuu

SEQ ID NO: 1061 - RNA, 21 nt, Artificial Sequence
  Synthetic polynucleotide
ggccugagagagacguucauu

SEQ ID NO: 1062 - RNA, 21 nt, Artificial Sequence
  Synthetic polynucleotide
gccugagagagacguucaguu

SEQ ID NO: 1063 - RNA, 21 nt, Artificial Sequence
  Synthetic polynucleotide
ccugagagagacguucagcuu

SEQ ID NO: 1064 - RNA, 21 nt, Artificial Sequence
  Synthetic polynucleotide
cugagagagacguucagcauu

SEQ ID NO: 1065 - RNA, 21 nt, Artificial Sequence
  Synthetic polynucleotide
cccuggggagcagagcagauu

SEQ ID NO: 1066 - RNA, 21 nt, Artificial Sequence
  Synthetic polynucleotide
ugagagagacguucagcaauu

SEQ ID NO: 1067 - RNA, 21 nt, Artificial Sequence
  Synthetic polynucleotide
gagagagacguucagcaacuu

SEQ ID NO: 1068 - RNA, 21 nt, Artificial Sequence
  Synthetic polynucleotide
agagagacguucagcaacuuu

SEQ ID NO: 1069 - RNA, 21 nt, Artificial Sequence
  Synthetic polynucleotide
gagagacguucagcaacuuuu

SEQ ID NO: 1070 - RNA, 21 nt, Artificial Sequence
  Synthetic polynucleotide
agagacguucagcaacuucuu

SEQ ID NO: 1071 - RNA, 21 nt, Artificial Sequence
  Synthetic polynucleotide
gagacguucagcaacuucauu

SEQ ID NO: 1072 - RNA, 21 nt, Artificial Sequence
  Synthetic polynucleotide
acggugcacggaagagugauu

SEQ ID NO: 1073 - RNA, 21 nt, Artificial Sequence
  Synthetic polynucleotide
agacguucagcaacuucacuu

SEQ ID NO: 1074 - RNA, 21 nt, Artificial Sequence
  Synthetic polynucleotide
gacguucagcaacuucacauu

SEQ ID NO: 1075 - RNA, 21 nt, Artificial Sequence
  Synthetic polynucleotide
acguucagcaacuucacaguu

SEQ ID NO: 1076 - RNA, 21 nt, Artificial Sequence
  Synthetic polynucleotide
cguucagcaacuucacagcuu

SEQ ID NO: 1077 - RNA, 21 nt, Artificial Sequence
  Synthetic polynucleotide
ccuggggagcagagcagaguu

SEQ ID NO: 1078 - RNA, 21 nt, Artificial Sequence
  Synthetic polynucleotide
guucagcaacuucacagcguu

SEQ ID NO: 1079 - RNA, 21 nt, Artificial Sequence
  Synthetic polynucleotide
uucagcaacuucacagcgauu

SEQ ID NO: 1080 - RNA, 21 nt, Artificial Sequence
  Synthetic polynucleotide
ucagcaacuucacagcgaguu

SEQ ID NO: 1081 - RNA, 21 nt, Artificial Sequence
  Synthetic polynucleotide
cagcaacuucacagcgagcuu

SEQ ID NO: 1082 - RNA, 21 nt, Artificial Sequence
  Synthetic polynucleotide
agcaacuucacagcgagcauu

SEQ ID NO: 1083 - RNA, 21 nt, Artificial Sequence
  Synthetic polynucleotide
gcaacuucacagcgagcacuu

SEQ ID NO: 1084 - RNA, 21 nt, Artificial Sequence
  Synthetic polynucleotide
caacuucacagcgagcacguu

SEQ ID NO: 1085 - RNA, 21 nt, Artificial Sequence
  Synthetic polynucleotide
aacuucacagcgagcacgguu

SEQ ID NO: 1086 - RNA, 21 nt, Artificial Sequence
  Synthetic polynucleotide
acuucacagcgagcacggauu

SEQ ID NO: 1087 - RNA, 21 nt, Artificial Sequence
  Synthetic polynucleotide
cuucacagcgagcacggaguu

SEQ ID NO: 1088 - RNA, 21 nt, Artificial Sequence
  Synthetic polynucleotide
cuggggagcagagcagagguu

SEQ ID NO: 1089 - RNA, 21 nt, Artificial Sequence
  Synthetic polynucleotide
uucacagcgagcacggagguu

SEQ ID NO: 1090 - RNA, 21 nt, Artificial Sequence
  Synthetic polynucleotide
ucacagcgagcacggaggcuu

SEQ ID NO: 1091 - RNA, 21 nt, Artificial Sequence
  Synthetic polynucleotide
cacagcgagcacggaggccuu

SEQ ID NO: 1092 - RNA, 21 nt, Artificial Sequence
  Synthetic polynucleotide
acagcgagcacggaggcccuu

SEQ ID NO: 1093 - RNA, 21 nt, Artificial Sequence
  Synthetic polynucleotide
cagcgagcacggaggcccauu

SEQ ID NO: 1094 - RNA, 21 nt, Artificial Sequence
  Synthetic polynucleotide
agcgagcacggaggcccaguu

SEQ ID NO: 1095 - RNA, 21 nt, Artificial Sequence
  Synthetic polynucleotide
gcgagcacggaggcccagguu

SEQ ID NO: 1096 - RNA, 21 nt, Artificial Sequence
  Synthetic polynucleotide
cgagcacggaggcccagguuu

SEQ ID NO: 1097 - RNA, 21 nt, Artificial Sequence
  Synthetic polynucleotide
gagcacggaggcccaggucuu

SEQ ID NO: 1098 - RNA, 21 nt, Artificial Sequence
  Synthetic polynucleotide
agcacggaggcccaggucauu

SEQ ID NO: 1099 - RNA, 21 nt, Artificial Sequence
  Synthetic polynucleotide
uggggagcagagcagaggcuu

SEQ ID NO: 1100 - RNA, 21 nt, Artificial Sequence
  Synthetic polynucleotide
gcacggaggcccaggucaauu

SEQ ID NO: 1101 - RNA, 21 nt, Artificial Sequence
  Synthetic polynucleotide
cacggaggcccaggucaaguu

SEQ ID NO: 1102 - RNA, 21 nt, Artificial Sequence
  Synthetic polynucleotide
acggaggcccaggucaagguu

SEQ ID NO: 1103 - RNA, 21 nt, Artificial Sequence
  Synthetic polynucleotide
cggaggcccaggucaaggguu

SEQ ID NO: 1104 - RNA, 21 nt, Artificial Sequence
  Synthetic polynucleotide
ggaggcccaggucaagggcuu

SEQ ID NO: 1105 - RNA, 21 nt, Artificial Sequence
  Synthetic polynucleotide
gaggcccaggucaagggcuuu

SEQ ID NO: 1106 - RNA, 21 nt, Artificial Sequence
  Synthetic polynucleotide
aggcccaggucaagggcuuuu

SEQ ID NO: 1107 - RNA, 21 nt, Artificial Sequence
  Synthetic polynucleotide
ggcccaggucaagggcuuguu

SEQ ID NO: 1108 - RNA, 21 nt, Artificial Sequence
  Synthetic polynucleotide
gcccaggucaagggcuugauu

SEQ ID NO: 1109 - RNA, 21 nt, Artificial Sequence
  Synthetic polynucleotide
cccaggucaagggcuugaguu

SEQ ID NO: 1110 - RNA, 21 nt, Artificial Sequence
  Synthetic polynucleotide
ggggagcagagcagaggcauu

SEQ ID NO: 1111 - RNA, 21 nt, Artificial Sequence
  Synthetic polynucleotide
ccaggucaagggcuugagcuu

SEQ ID NO: 1112 - RNA, 21 nt, Artificial Sequence
  Synthetic polynucleotide
caggucaagggcuugagcauu

SEQ ID NO: 1113 - RNA, 21 nt, Artificial Sequence
  Synthetic polynucleotide
aggucaagggcuugagcacuu

SEQ ID NO: 1114 - RNA, 21 nt, Artificial Sequence
  Synthetic polynucleotide
ggucaagggcuugagcaccuu

SEQ ID NO: 1115 - RNA, 21 nt, Artificial Sequence
  Synthetic polynucleotide
gucaagggcuugagcacccuu

SEQ ID NO: 1116 - RNA, 21 nt, Artificial Sequence
  Synthetic polynucleotide
ucaagggcuugagcacccauu

SEQ ID NO: 1117 - RNA, 21 nt, Artificial Sequence
  Synthetic polynucleotide
caagggcuugagcacccaguu

SEQ ID NO: 1118 - RNA, 21 nt, Artificial Sequence
  Synthetic polynucleotide
aagggcuugagcacccagguu

SEQ ID NO: 1119 - RNA, 21 nt, Artificial Sequence
  Synthetic polynucleotide
agggcuugagcacccaggguu

SEQ ID NO: 1120 - RNA, 21 nt, Artificial Sequence
  Synthetic polynucleotide
gggcuugagcacccagggauu

SEQ ID NO: 1121 - RNA, 21 nt, Artificial Sequence
  Synthetic polynucleotide
gggagcagagcagaggcaauu

SEQ ID NO: 1122 - RNA, 21 nt, Artificial Sequence
  Synthetic polynucleotide
ggcuugagcacccagggaguu

SEQ ID NO: 1123 - RNA, 21 nt, Artificial Sequence
  Synthetic polynucleotide
gcuugagcacccagggagguu

SEQ ID NO: 1124 - RNA, 21 nt, Artificial Sequence
  Synthetic polynucleotide
cuugagcacccagggaggcuu

SEQ ID NO: 1125 - RNA, 21 nt, Artificial Sequence
  Synthetic polynucleotide
uugagcacccagggaggcauu

SEQ ID NO: 1126 - RNA, 21 nt, Artificial Sequence
  Synthetic polynucleotide
ugagcacccagggaggcaauu

SEQ ID NO: 1127 - RNA, 21 nt, Artificial Sequence
  Synthetic polynucleotide
gagcacccagggaggcaauuu

SEQ ID NO: 1128 - RNA, 21 nt, Artificial Sequence
  Synthetic polynucleotide
agcacccagggaggcaauguu

SEQ ID NO: 1129 - RNA, 21 nt, Artificial Sequence
  Synthetic polynucleotide
gcacccagggaggcaauguuu

SEQ ID NO: 1130 - RNA, 21 nt, Artificial Sequence
  Synthetic polynucleotide
cacccagggaggcaauguguu

SEQ ID NO: 1131 - RNA, 21 nt, Artificial Sequence
  Synthetic polynucleotide
acccagggaggcaaugugguu

SEQ ID NO: 1132 - RNA, 21 nt, Artificial Sequence
  Synthetic polynucleotide
ggagcagagcagaggcaacuu

SEQ ID NO: 1133 - RNA, 21 nt, Artificial Sequence
  Synthetic polynucleotide
cccagggaggcaauguggguu

SEQ ID NO: 1134 - RNA, 21 nt, Artificial Sequence
  Synthetic polynucleotide
ccagggaggcaaugugggauu

SEQ ID NO: 1135 - RNA, 21 nt, Artificial Sequence
  Synthetic polynucleotide
cagggaggcaaugugggaauu

SEQ ID NO: 1136 - RNA, 21 nt, Artificial Sequence
  Synthetic polynucleotide
agggaggcaaugugggaaguu

SEQ ID NO: 1137 - RNA, 21 nt, Artificial Sequence
  Synthetic polynucleotide
gggaggcaaugugggaagauu

SEQ ID NO: 1138 - RNA, 21 nt, Artificial Sequence
  Synthetic polynucleotide
ggaggcaaugugggaagaauu

SEQ ID NO: 1139 - RNA, 21 nt, Artificial Sequence
  Synthetic polynucleotide
gaggcaaugugggaagaaauu

SEQ ID NO: 1140 - RNA, 21 nt, Artificial Sequence
  Synthetic polynucleotide
aggcaaugugggaagaaaguu

SEQ ID NO: 1141 - RNA, 21 nt, Artificial Sequence
  Synthetic polynucleotide
ggcaaugugggaagaaagauu

SEQ ID NO: 1142 - RNA, 21 nt, Artificial Sequence
  Synthetic polynucleotide
gcaaugugggaagaaagauuu

SEQ ID NO: 1143 - RNA, 21 nt, Artificial Sequence
  Synthetic polynucleotide
gagcagagcagaggcaaccuu

SEQ ID NO: 1144 - RNA, 21 nt, Artificial Sequence
  Synthetic polynucleotide
caaugugggaagaaagauguu

SEQ ID NO: 1145 - RNA, 21 nt, Artificial Sequence
  Synthetic polynucleotide
aaugugggaagaaagaugauu

SEQ ID NO: 1146 - RNA, 21 nt, Artificial Sequence
  Synthetic polynucleotide
augugggaagaaagaugaauu

SEQ ID NO: 1147 - RNA, 21 nt, Artificial Sequence
  Synthetic polynucleotide
ugugggaagaaagaugaaguu

SEQ ID NO: 1148 - RNA, 21 nt, Artificial Sequence
  Synthetic polynucleotide
gugggaagaaagaugaaguuu

SEQ ID NO: 1149 - RNA, 21 nt, Artificial Sequence
  Synthetic polynucleotide
ugggaagaaagaugaagucuu

SEQ ID NO: 1150 - RNA, 21 nt, Artificial Sequence
  Synthetic polynucleotide
gggaagaaagaugaagucguu

SEQ ID NO: 1151 - RNA, 21 nt, Artificial Sequence
  Synthetic polynucleotide
ggaagaaagaugaagucgcuu

SEQ ID NO: 1152 - RNA, 21 nt, Artificial Sequence
  Synthetic polynucleotide
gaagaaagaugaagucgcuuu

SEQ ID NO: 1153 - RNA, 21 nt, Artificial Sequence
  Synthetic polynucleotide
aagaaagaugaagucgcuauu

SEQ ID NO: 1154 - RNA, 21 nt, Artificial Sequence
  Synthetic polynucleotide
agcagagcagaggcaacccuu

SEQ ID NO: 1155 - RNA, 21 nt, Artificial Sequence
  Synthetic polynucleotide
agaaagaugaagucgcuaguu

SEQ ID NO: 1156 - RNA, 21 nt, Artificial Sequence
  Synthetic polynucleotide
gaaagaugaagucgcuagauu

SEQ ID NO: 1157 - RNA, 21 nt, Artificial Sequence
  Synthetic polynucleotide
aaagaugaagucgcuagaguu

SEQ ID NO: 1158 - RNA, 21 nt, Artificial Sequence
  Synthetic polynucleotide
aagaugaagucgcuagaguuu

SEQ ID NO: 1159 - RNA, 21 nt, Artificial Sequence
  Synthetic polynucleotide
agaugaagucgcuagagucuu

SEQ ID NO: 1160 - RNA, 21 nt, Artificial Sequence
  Synthetic polynucleotide
gaugaagucgcuagaguccuu

SEQ ID NO: 1161 - RNA, 21 nt, Artificial Sequence
  Synthetic polynucleotide
augaagucgcuagagucccuu

SEQ ID NO: 1162 - RNA, 21 nt, Artificial Sequence
  Synthetic polynucleotide
ugaagucgcuagagucccauu

SEQ ID NO: 1163 - RNA, 21 nt, Artificial Sequence
  Synthetic polynucleotide
gaagucgcuagagucccaguu

SEQ ID NO: 1164 - RNA, 21 nt, Artificial Sequence
  Synthetic polynucleotide
aagucgcuagagucccagcuu

SEQ ID NO: 1165 - RNA, 21 nt, Artificial Sequence
  Synthetic polynucleotide
agucgcuagagucccagcuuu

SEQ ID NO: 1166 - RNA, 21 nt, Artificial Sequence
  Synthetic polynucleotide
gcagagcagaggcaacccauu

SEQ ID NO: 1167 - RNA, 21 nt, Artificial Sequence
  Synthetic polynucleotide
gucgcuagagucccagcuguu

SEQ ID NO: 1168 - RNA, 21 nt, Artificial Sequence
  Synthetic polynucleotide
ucgcuagagucccagcugguu

SEQ ID NO: 1169 - RNA, 21 nt, Artificial Sequence
  Synthetic polynucleotide
cgcuagagucccagcuggauu

SEQ ID NO: 1170 - RNA, 21 nt, Artificial Sequence
  Synthetic polynucleotide
gcuagagucccagcuggaguu

SEQ ID NO: 1171 - RNA, 21 nt, Artificial Sequence
  Synthetic polynucleotide
cuagagucccagcuggagauu

SEQ ID NO: 1172 - RNA, 21 nt, Artificial Sequence
  Synthetic polynucleotide
uagagucccagcuggagaauu

SEQ ID NO: 1173 - RNA, 21 nt, Artificial Sequence
  Synthetic polynucleotide
agagucccagcuggagaaauu

SEQ ID NO: 1174 - RNA, 21 nt, Artificial Sequence
  Synthetic polynucleotide
gagucccagcuggagaaacuu

SEQ ID NO: 1175 - RNA, 21 nt, Artificial Sequence
  Synthetic polynucleotide
agucccagcuggagaaacauu

SEQ ID NO: 1176 - RNA, 21 nt, Artificial Sequence
  Synthetic polynucleotide
gucccagcuggagaaacaguu

SEQ ID NO: 1177 - RNA, 21 nt, Artificial Sequence
  Synthetic polynucleotide
cagagcagaggcaacccauuu

SEQ ID NO: 1178 - RNA, 21 nt, Artificial Sequence
  Synthetic polynucleotide
ucccagcuggagaaacagcuu

SEQ ID NO: 1179 - RNA, 21 nt, Artificial Sequence
  Synthetic polynucleotide
cccagcuggagaaacagcauu

SEQ ID NO: 1180 - RNA, 21 nt, Artificial Sequence
  Synthetic polynucleotide
ccagcuggagaaacagcaguu

SEQ ID NO: 1181 - RNA, 21 nt, Artificial Sequence
  Synthetic polynucleotide
cagcuggagaaacagcagauu

SEQ ID NO: 1182 - RNA, 21 nt, Artificial Sequence
  Synthetic polynucleotide
agcuggagaaacagcagaauu

SEQ ID NO: 1183 - RNA, 21 nt, Artificial Sequence
  Synthetic polynucleotide
gcuggagaaacagcagaaguu

SEQ ID NO: 1184 - RNA, 21 nt, Artificial Sequence
  Synthetic polynucleotide
cggugcacggaagagugaguu

SEQ ID NO: 1185 - RNA, 21 nt, Artificial Sequence
  Synthetic polynucleotide
cuggagaaacagcagaagguu

SEQ ID NO: 1186 - RNA, 21 nt, Artificial Sequence
  Synthetic polynucleotide
uggagaaacagcagaaggauu

SEQ ID NO: 1187 - RNA, 21 nt, Artificial Sequence
  Synthetic polynucleotide
ggagaaacagcagaaggacuu

SEQ ID NO: 1188 - RNA, 21 nt, Artificial Sequence
  Synthetic polynucleotide
gagaaacagcagaaggaccuu

SEQ ID NO: 1189 - RNA, 21 nt, Artificial Sequence
  Synthetic polynucleotide
agagcagaggcaacccaucuu

SEQ ID NO: 1190 - RNA, 21 nt, Artificial Sequence
  Synthetic polynucleotide
agaaacagcagaaggaccuuu

SEQ ID NO: 1191 - RNA, 21 nt, Artificial Sequence
  Synthetic polynucleotide
gaaacagcagaaggaccuguu

SEQ ID NO: 1192 - RNA, 21 nt, Artificial Sequence
  Synthetic polynucleotide
aaacagcagaaggaccugauu

SEQ ID NO: 1193 - RNA, 21 nt, Artificial Sequence
  Synthetic polynucleotide
aacagcagaaggaccugaguu

SEQ ID NO: 1194 - RNA, 21 nt, Artificial Sequence
  Synthetic polynucleotide
acagcagaaggaccugaguuu

SEQ ID NO: 1195 - RNA, 21 nt, Artificial Sequence
  Synthetic polynucleotide
cagcagaaggaccugaguguu

SEQ ID NO: 1196 - RNA, 21 nt, Artificial Sequence
  Synthetic polynucleotide
agcagaaggaccugagugauu

SEQ ID NO: 1197 - RNA, 21 nt, Artificial Sequence
  Synthetic polynucleotide
gcagaaggaccugagugaauu

SEQ ID NO: 1198 - RNA, 21 nt, Artificial Sequence
  Synthetic polynucleotide
cagaaggaccugagugaaguu

SEQ ID NO: 1199 - RNA, 21 nt, Artificial Sequence
  Synthetic polynucleotide
agaaggaccugagugaagauu

SEQ ID NO: 1200 - RNA, 21 nt, Artificial Sequence
  Synthetic polynucleotide
gagcagaggcaacccauccuu

SEQ ID NO: 1201 - RNA, 21 nt, Artificial Sequence
  Synthetic polynucleotide
gaaggaccugagugaagauuu

SEQ ID NO: 1202 - RNA, 21 nt, Artificial Sequence
  Synthetic polynucleotide
aaggaccugagugaagaucuu

SEQ ID NO: 1203 - RNA, 21 nt, Artificial Sequence
  Synthetic polynucleotide
aggaccugagugaagaucauu

SEQ ID NO: 1204 - RNA, 21 nt, Artificial Sequence
  Synthetic polynucleotide
ggaccugagugaagaucacuu

SEQ ID NO: 1205 - RNA, 21 nt, Artificial Sequence
  Synthetic polynucleotide
gaccugagugaagaucacuuu

SEQ ID NO: 1206 - RNA, 21 nt, Artificial Sequence
  Synthetic polynucleotide
accugagugaagaucacucuu

SEQ ID NO: 1207 - RNA, 21 nt, Artificial Sequence
  Synthetic polynucleotide
ccugagugaagaucacuccuu

SEQ ID NO: 1208 - RNA, 21 nt, Artificial Sequence
  Synthetic polynucleotide
cugagugaagaucacuccauu

SEQ ID NO: 1209 - RNA, 21 nt, Artificial Sequence
  Synthetic polynucleotide
ugagugaagaucacuccaguu

SEQ ID NO: 1210 - RNA, 21 nt, Artificial Sequence
  Synthetic polynucleotide
gagugaagaucacuccagcuu

SEQ ID NO: 1211 - RNA, 21 nt, Artificial Sequence
  Synthetic polynucleotide
agcagaggcaacccaucccuu

SEQ ID NO: 1212 - RNA, 21 nt, Artificial Sequence
  Synthetic polynucleotide
agugaagaucacuccagccuu

SEQ ID NO: 1213 - RNA, 21 nt, Artificial Sequence
  Synthetic polynucleotide
gugaagaucacuccagccuuu

SEQ ID NO: 1214 - RNA, 21 nt, Artificial Sequence
  Synthetic polynucleotide
ugaagaucacuccagccuguu

SEQ ID NO: 1215 - RNA, 21 nt, Artificial Sequence
  Synthetic polynucleotide
gaagaucacuccagccugcuu

SEQ ID NO: 1216 - RNA, 21 nt, Artificial Sequence
  Synthetic polynucleotide
aagaucacuccagccugcuuu

SEQ ID NO: 1217 - RNA, 21 nt, Artificial Sequence
  Synthetic polynucleotide
agaucacuccagccugcuguu

SEQ ID NO: 1218 - RNA, 21 nt, Artificial Sequence
  Synthetic polynucleotide
gaucacuccagccugcugcuu

SEQ ID NO: 1219 - RNA, 21 nt, Artificial Sequence
  Synthetic polynucleotide
aucacuccagccugcugcuuu

SEQ ID NO: 1220 - RNA, 21 nt, Artificial Sequence
  Synthetic polynucleotide
ucacuccagccugcugcucuu

SEQ ID NO: 1221 - RNA, 21 nt, Artificial Sequence
  Synthetic polynucleotide
cacuccagccugcugcuccuu

SEQ ID NO: 1222 - RNA, 21 nt, Artificial Sequence
  Synthetic polynucleotide
gcagaggcaacccauccccuu

SEQ ID NO: 1223 - RNA, 21 nt, Artificial Sequence
  Synthetic polynucleotide
acuccagccugcugcuccauu

SEQ ID NO: 1224 - RNA, 21 nt, Artificial Sequence
  Synthetic polynucleotide
cuccagccugcugcuccacuu

SEQ ID NO: 1225 - RNA, 21 nt, Artificial Sequence
  Synthetic polynucleotide
uccagccugcugcuccacguu

SEQ ID NO: 1226 - RNA, 21 nt, Artificial Sequence
  Synthetic polynucleotide
ccagccugcugcuccacguuu

SEQ ID NO: 1227 - RNA, 21 nt, Artificial Sequence
  Synthetic polynucleotide
cagccugcugcuccacguguu

SEQ ID NO: 1228 - RNA, 21 nt, Artificial Sequence
  Synthetic polynucleotide
agccugcugcuccacgugauu

SEQ ID NO: 1229 - RNA, 21 nt, Artificial Sequence
  Synthetic polynucleotide
gccugcugcuccacgugaauu

SEQ ID NO: 1230 - RNA, 21 nt, Artificial Sequence
  Synthetic polynucleotide
ccugcugcuccacgugaaguu

SEQ ID NO: 1231 - RNA, 21 nt, Artificial Sequence
  Synthetic polynucleotide
cugcugcuccacgugaagcuu

SEQ ID NO: 1232 - RNA, 21 nt, Artificial Sequence
  Synthetic polynucleotide
ugcugcuccacgugaagcauu

SEQ ID NO: 1233 - RNA, 21 nt, Artificial Sequence
  Synthetic polynucleotide
cagaggcaacccaucccccuu

SEQ ID NO: 1234 - RNA, 21 nt, Artificial Sequence
  Synthetic polynucleotide
gcugcuccacgugaagcaguu

SEQ ID NO: 1235 - RNA, 21 nt, Artificial Sequence
  Synthetic polynucleotide
cugcuccacgugaagcaguuu

SEQ ID NO: 1236 - RNA, 21 nt, Artificial Sequence
  Synthetic polynucleotide
ugcuccacgugaagcaguuuu

SEQ ID NO: 1237 - RNA, 21 nt, Artificial Sequence
  Synthetic polynucleotide
gcuccacgugaagcaguucuu

SEQ ID NO: 1238 - RNA, 21 nt, Artificial Sequence
  Synthetic polynucleotide
cuccacgugaagcaguucguu

SEQ ID NO: 1239 - RNA, 21 nt, Artificial Sequence
  Synthetic polynucleotide
uccacgugaagcaguucguuu

SEQ ID NO: 1240 - RNA, 21 nt, Artificial Sequence
  Synthetic polynucleotide
ccacgugaagcaguucguguu

SEQ ID NO: 1241 - RNA, 21 nt, Artificial Sequence
  Synthetic polynucleotide
cacgugaagcaguucguguuu

SEQ ID NO: 1242 - RNA, 21 nt, Artificial Sequence
  Synthetic polynucleotide
acgugaagcaguucgugucuu

SEQ ID NO: 1243 - RNA, 21 nt, Artificial Sequence
  Synthetic polynucleotide
cgugaagcaguucgugucuuu

SEQ ID NO: 1244 - RNA, 21 nt, Artificial Sequence
  Synthetic polynucleotide
agaggcaacccaucccccauu

SEQ ID NO: 1245 - RNA, 21 nt, Artificial Sequence
  Synthetic polynucleotide
gugaagcaguucgugucuguu

SEQ ID NO: 1246 - RNA, 21 nt, Artificial Sequence
  Synthetic polynucleotide
ugaagcaguucgugucugauu

SEQ ID NO: 1247 - RNA, 21 nt, Artificial Sequence
  Synthetic polynucleotide
gaagcaguucgugucugacuu

SEQ ID NO: 1248 - RNA, 21 nt, Artificial Sequence
  Synthetic polynucleotide
aagcaguucgugucugaccuu

SEQ ID NO: 1249 - RNA, 21 nt, Artificial Sequence
  Synthetic polynucleotide
agcaguucgugucugaccuuu

SEQ ID NO: 1250 - RNA, 21 nt, Artificial Sequence
  Synthetic polynucleotide
gcaguucgugucugaccuguu

SEQ ID NO: 1251 - RNA, 21 nt, Artificial Sequence
  Synthetic polynucleotide
caguucgugucugaccugcuu

SEQ ID NO: 1252 - RNA, 21 nt, Artificial Sequence
  Synthetic polynucleotide
aguucgugucugaccugcguu

SEQ ID NO: 1253 - RNA, 21 nt, Artificial Sequence
  Synthetic polynucleotide
guucgugucugaccugcgguu

SEQ ID NO: 1254 - RNA, 21 nt, Artificial Sequence
  Synthetic polynucleotide
uucgugucugaccugcggauu

SEQ ID NO: 1255 - RNA, 21 nt, Artificial Sequence
  Synthetic polynucleotide
gaggcaacccaucccccacuu

SEQ ID NO: 1256 - RNA, 21 nt, Artificial Sequence
  Synthetic polynucleotide
ucgugucugaccugcggaguu

SEQ ID NO: 1257 - RNA, 21 nt, Artificial Sequence
  Synthetic polynucleotide
cgugucugaccugcggagcuu

SEQ ID NO: 1258 - RNA, 21 nt, Artificial Sequence
  Synthetic polynucleotide
gugucugaccugcggagccuu

SEQ ID NO: 1259 - RNA, 21 nt, Artificial Sequence
  Synthetic polynucleotide
ugucugaccugcggagccuuu

SEQ ID NO: 1260 - RNA, 21 nt, Artificial Sequence
  Synthetic polynucleotide
gucugaccugcggagccuguu

SEQ ID NO: 1261 - RNA, 21 nt, Artificial Sequence
  Synthetic polynucleotide
ucugaccugcggagccugauu

SEQ ID NO: 1262 - RNA, 21 nt, Artificial Sequence
  Synthetic polynucleotide
cugaccugcggagccugaguu

SEQ ID NO: 1263 - RNA, 21 nt, Artificial Sequence
  Synthetic polynucleotide
ugaccugcggagccugagcuu

SEQ ID NO: 1264 - RNA, 21 nt, Artificial Sequence
  Synthetic polynucleotide
gaccugcggagccugagcuuu

SEQ ID NO: 1265 - RNA, 21 nt, Artificial Sequence
  Synthetic polynucleotide
accugcggagccugagcuguu

SEQ ID NO: 1266 - RNA, 21 nt, Artificial Sequence
  Synthetic polynucleotide
aggcaacccaucccccacuuu

SEQ ID NO: 1267 - RNA, 21 nt, Artificial Sequence
  Synthetic polynucleotide
ccugcggagccugagcuguuu

SEQ ID NO: 1268 - RNA, 21 nt, Artificial Sequence
  Synthetic polynucleotide
cugcggagccugagcugucuu

SEQ ID NO: 1269 - RNA, 21 nt, Artificial Sequence
  Synthetic polynucleotide
ugcggagccugagcugucauu

SEQ ID NO: 1270 - RNA, 21 nt, Artificial Sequence
  Synthetic polynucleotide
gcggagccugagcugucaguu

SEQ ID NO: 1271 - RNA, 21 nt, Artificial Sequence
  Synthetic polynucleotide
cggagccugagcugucagauu

SEQ ID NO: 1272 - RNA, 21 nt, Artificial Sequence
  Synthetic polynucleotide
ggagccugagcugucagauuu

SEQ ID NO: 1273 - RNA, 21 nt, Artificial Sequence
  Synthetic polynucleotide
gagccugagcugucagauguu

SEQ ID NO: 1274 - RNA, 21 nt, Artificial Sequence
  Synthetic polynucleotide
agccugagcugucagaugguu

SEQ ID NO: 1275 - RNA, 21 nt, Artificial Sequence
  Synthetic polynucleotide
gccugagcugucagauggcuu

SEQ ID NO: 1276 - RNA, 21 nt, Artificial Sequence
  Synthetic polynucleotide
ccugagcugucagauggcguu

SEQ ID NO: 1277 - RNA, 21 nt, Artificial Sequence
  Synthetic polynucleotide
ggcaacccaucccccacucuu

SEQ ID NO: 1278 - RNA, 21 nt, Artificial Sequence
  Synthetic polynucleotide
cugagcugucagauggcgguu

SEQ ID NO: 1279 - RNA, 21 nt, Artificial Sequence
  Synthetic polynucleotide
ugagcugucagauggcggcuu

SEQ ID NO: 1280 - RNA, 21 nt, Artificial Sequence
  Synthetic polynucleotide
gagcugucagauggcggcguu

SEQ ID NO: 1281 - RNA, 21 nt, Artificial Sequence
  Synthetic polynucleotide
agcugucagauggcggcgcuu

SEQ ID NO: 1282 - RNA, 21 nt, Artificial Sequence
  Synthetic polynucleotide
gcugucagauggcggcgcuuu

SEQ ID NO: 1283 - RNA, 21 nt, Artificial Sequence
  Synthetic polynucleotide
cugucagauggcggcgcucuu

SEQ ID NO: 1284 - RNA, 21 nt, Artificial Sequence
  Synthetic polynucleotide
ugucagauggcggcgcuccuu

SEQ ID NO: 1285 - RNA, 21 nt, Artificial Sequence
  Synthetic polynucleotide
gucagauggcggcgcuccauu

SEQ ID NO: 1286 - RNA, 21 nt, Artificial Sequence
  Synthetic polynucleotide
ucagauggcggcgcuccaguu

SEQ ID NO: 1287 - RNA, 21 nt, Artificial Sequence
  Synthetic polynucleotide
cagauggcggcgcuccagguu

SEQ ID NO: 1288 - RNA, 21 nt, Artificial Sequence
  Synthetic polynucleotide
agauggcggcgcuccaggguu

SEQ ID NO: 1289 - RNA, 21 nt, Artificial Sequence
  Synthetic polynucleotide
gcaacccaucccccacuccuu

SEQ ID NO: 1290 - RNA, 21 nt, Artificial Sequence
  Synthetic polynucleotide
gauggcggcgcuccagggcuu

SEQ ID NO: 1291 - RNA, 21 nt, Artificial Sequence
  Synthetic polynucleotide
caacccaucccccacucccuu

SEQ ID NO: 1292 - RNA, 21 nt, Artificial Sequence
  Synthetic polynucleotide
auggcggcgcuccagggcauu

SEQ ID NO: 1293 - RNA, 21 nt, Artificial Sequence
  Synthetic polynucleotide
uggcggcgcuccagggcaauu

SEQ ID NO: 1294 - RNA, 21 nt, Artificial Sequence
  Synthetic polynucleotide
ggcggcgcuccagggcaauuu

SEQ ID NO: 1295 - RNA, 21 nt, Artificial Sequence
  Synthetic polynucleotide
gcggcgcuccagggcaauguu

SEQ ID NO: 1296 - RNA, 21 nt, Artificial Sequence
  Synthetic polynucleotide
cggcgcuccagggcaaugguu

SEQ ID NO: 1297 - RNA, 21 nt, Artificial Sequence
  Synthetic polynucleotide
ggugcacggaagagugagguu

SEQ ID NO: 1298 - RNA, 21 nt, Artificial Sequence
  Synthetic polynucleotide
ggcgcuccagggcaauggcuu

SEQ ID NO: 1299 - RNA, 21 nt, Artificial Sequence
  Synthetic polynucleotide
gcgcuccagggcaauggcuuu

SEQ ID NO: 1300 - RNA, 21 nt, Artificial Sequence
  Synthetic polynucleotide
cgcuccagggcaauggcucuu

SEQ ID NO: 1301 - RNA, 21 nt, Artificial Sequence
  Synthetic polynucleotide
gcuccagggcaauggcucauu

SEQ ID NO: 1302 - RNA, 21 nt, Artificial Sequence
  Synthetic polynucleotide
cuccagggcaauggcucaguu

SEQ ID NO: 1303 - RNA, 21 nt, Artificial Sequence
  Synthetic polynucleotide
aacccaucccccacucccauu

SEQ ID NO: 1304 - RNA, 21 nt, Artificial Sequence
  Synthetic polynucleotide
uccagggcaauggcucagauu

SEQ ID NO: 1305 - RNA, 21 nt, Artificial Sequence
  Synthetic polynucleotide
ccagggcaauggcucagaauu

SEQ ID NO: 1306 - RNA, 21 nt, Artificial Sequence
  Synthetic polynucleotide
cagggcaauggcucagaaauu

SEQ ID NO: 1307 - RNA, 21 nt, Artificial Sequence
  Synthetic polynucleotide
agggcaauggcucagaaaguu

SEQ ID NO: 1308 - RNA, 21 nt, Artificial Sequence
  Synthetic polynucleotide
gggcaauggcucagaaagguu

SEQ ID NO: 1309 - RNA, 21 nt, Artificial Sequence
  Synthetic polynucleotide
ggcaauggcucagaaaggauu

SEQ ID NO: 1310 - RNA, 21 nt, Artificial Sequence
  Synthetic polynucleotide
gcaauggcucagaaaggacuu

SEQ ID NO: 1311 - RNA, 21 nt, Artificial Sequence
  Synthetic polynucleotide
caauggcucagaaaggaccuu

SEQ ID NO: 1312 - RNA, 21 nt, Artificial Sequence
  Synthetic polynucleotide
aauggcucagaaaggaccuuu

SEQ ID NO: 1313 - RNA, 21 nt, Artificial Sequence
  Synthetic polynucleotide
auggcucagaaaggaccuguu

SEQ ID NO: 1314 - RNA, 21 nt, Artificial Sequence
  Synthetic polynucleotide
acccaucccccacucccacuu

SEQ ID NO: 1315 - RNA, 21 nt, Artificial Sequence
  Synthetic polynucleotide
uggcucagaaaggaccugcuu

SEQ ID NO: 1316 - RNA, 21 nt, Artificial Sequence
  Synthetic polynucleotide
ggcucagaaaggaccugcuuu

SEQ ID NO: 1317 - RNA, 21 nt, Artificial Sequence
  Synthetic polynucleotide
gcucagaaaggaccugcuguu

SEQ ID NO: 1318 - RNA, 21 nt, Artificial Sequence
  Synthetic polynucleotide
cucagaaaggaccugcugcuu

SEQ ID NO: 1319 - RNA, 21 nt, Artificial Sequence
  Synthetic polynucleotide
ucagaaaggaccugcugccuu

SEQ ID NO: 1320 - RNA, 21 nt, Artificial Sequence
  Synthetic polynucleotide
cagaaaggaccugcugcccuu

SEQ ID NO: 1321 - RNA, 21 nt, Artificial Sequence
  Synthetic polynucleotide
agaaaggaccugcugcccguu

SEQ ID NO: 1322 - RNA, 21 nt, Artificial Sequence
  Synthetic polynucleotide
gaaaggaccugcugcccgguu

SEQ ID NO: 1323 - RNA, 21 nt, Artificial Sequence
  Synthetic polynucleotide
aaaggaccugcugcccgguuu

SEQ ID NO: 1324 - RNA, 21 nt, Artificial Sequence
  Synthetic polynucleotide
aaggaccugcugcccggucuu

SEQ ID NO: 1325 - RNA, 21 nt, Artificial Sequence
  Synthetic polynucleotide
cccaucccccacucccaccuu

SEQ ID NO: 1326 - RNA, 21 nt, Artificial Sequence
  Synthetic polynucleotide
aggaccugcugcccggucauu

SEQ ID NO: 1327 - RNA, 21 nt, Artificial Sequence
  Synthetic polynucleotide
ggaccugcugcccggucaauu

SEQ ID NO: 1328 - RNA, 21 nt, Artificial Sequence
  Synthetic polynucleotide
gaccugcugcccggucaacuu

SEQ ID NO: 1329 - RNA, 21 nt, Artificial Sequence
  Synthetic polynucleotide
accugcugcccggucaacuuu

SEQ ID NO: 1330 - RNA, 21 nt, Artificial Sequence
  Synthetic polynucleotide
ccugcugcccggucaacuguu

SEQ ID NO: 1331 - RNA, 21 nt, Artificial Sequence
  Synthetic polynucleotide
cugcugcccggucaacugguu

SEQ ID NO: 1332 - RNA, 21 nt, Artificial Sequence
  Synthetic polynucleotide
ugcugcccggucaacuggguu

SEQ ID NO: 1333 - RNA, 21 nt, Artificial Sequence
  Synthetic polynucleotide
gcugcccggucaacuggguuu

SEQ ID NO: 1334 - RNA, 21 nt, Artificial Sequence
  Synthetic polynucleotide
cugcccggucaacuggguguu

SEQ ID NO: 1335 - RNA, 21 nt, Artificial Sequence
  Synthetic polynucleotide
ugcccggucaacugggugguu

SEQ ID NO: 1336 - RNA, 21 nt, Artificial Sequence
  Synthetic polynucleotide
ccaucccccacucccacccuu

SEQ ID NO: 1337 - RNA, 21 nt, Artificial Sequence
  Synthetic polynucleotide
gcccggucaacuggguggauu

SEQ ID NO: 1338 - RNA, 21 nt, Artificial Sequence
  Synthetic polynucleotide
cccggucaacuggguggaguu

SEQ ID NO: 1339 - RNA, 21 nt, Artificial Sequence
  Synthetic polynucleotide
ccggucaacuggguggagcuu

SEQ ID NO: 1340 - RNA, 21 nt, Artificial Sequence
  Synthetic polynucleotide
cggucaacuggguggagcauu

SEQ ID NO: 1341 - RNA, 21 nt, Artificial Sequence
  Synthetic polynucleotide
ggucaacuggguggagcacuu

SEQ ID NO: 1342 - RNA, 21 nt, Artificial Sequence
  Synthetic polynucleotide
gucaacuggguggagcacguu

SEQ ID NO: 1343 - RNA, 21 nt, Artificial Sequence
  Synthetic polynucleotide
ucaacuggguggagcacgauu

SEQ ID NO: 1344 - RNA, 21 nt, Artificial Sequence
  Synthetic polynucleotide
caacuggguggagcacgaguu

SEQ ID NO: 1345 - RNA, 21 nt, Artificial Sequence
  Synthetic polynucleotide
aacuggguggagcacgagcuu

SEQ ID NO: 1346 - RNA, 21 nt, Artificial Sequence
  Synthetic polynucleotide
acuggguggagcacgagcguu

SEQ ID NO: 1347 - RNA, 21 nt, Artificial Sequence
  Synthetic polynucleotide
caucccccacucccaccccuu

SEQ ID NO: 1348 - RNA, 21 nt, Artificial Sequence
  Synthetic polynucleotide
cuggguggagcacgagcgcuu

SEQ ID NO: 1349 - RNA, 21 nt, Artificial Sequence
  Synthetic polynucleotide
uggguggagcacgagcgcauu

SEQ ID NO: 1350 - RNA, 21 nt, Artificial Sequence
  Synthetic polynucleotide
ggguggagcacgagcgcaguu

SEQ ID NO: 1351 - RNA, 21 nt, Artificial Sequence
  Synthetic polynucleotide
gguggagcacgagcgcagcuu

SEQ ID NO: 1352 - RNA, 21 nt, Artificial Sequence
  Synthetic polynucleotide
guggagcacgagcgcagcuuu

SEQ ID NO: 1353 - RNA, 21 nt, Artificial Sequence
  Synthetic polynucleotide
uggagcacgagcgcagcuguu

SEQ ID NO: 1354 - RNA, 21 nt, Artificial Sequence
  Synthetic polynucleotide
ggagcacgagcgcagcugcuu

SEQ ID NO: 1355 - RNA, 21 nt, Artificial Sequence
  Synthetic polynucleotide
gagcacgagcgcagcugcuuu

SEQ ID NO: 1356 - RNA, 21 nt, Artificial Sequence
  Synthetic polynucleotide
agcacgagcgcagcugcuauu

SEQ ID NO: 1357 - RNA, 21 nt, Artificial Sequence
  Synthetic polynucleotide
gcacgagcgcagcugcuacuu

SEQ ID NO: 1358 - RNA, 21 nt, Artificial Sequence
  Synthetic polynucleotide
aucccccacucccacccccuu

SEQ ID NO: 1359 - RNA, 21 nt, Artificial Sequence
  Synthetic polynucleotide
cacgagcgcagcugcuacuuu

SEQ ID NO: 1360 - RNA, 21 nt, Artificial Sequence
  Synthetic polynucleotide
acgagcgcagcugcuacuguu

SEQ ID NO: 1361 - RNA, 21 nt, Artificial Sequence
  Synthetic polynucleotide
cgagcgcagcugcuacugguu

SEQ ID NO: 1362 - RNA, 21 nt, Artificial Sequence
  Synthetic polynucleotide
gagcgcagcugcuacugguuu

SEQ ID NO: 1363 - RNA, 21 nt, Artificial Sequence
  Synthetic polynucleotide
agcgcagcugcuacugguuuu

SEQ ID NO: 1364 - RNA, 21 nt, Artificial Sequence
  Synthetic polynucleotide
gcgcagcugcuacugguucuu

SEQ ID NO: 1365 - RNA, 21 nt, Artificial Sequence
  Synthetic polynucleotide
cgcagcugcuacugguucuuu

SEQ ID NO: 1366 - RNA, 21 nt, Artificial Sequence
  Synthetic polynucleotide
gcagcugcuacugguucucuu

SEQ ID NO: 1367 - RNA, 21 nt, Artificial Sequence
  Synthetic polynucleotide
cagcugcuacugguucucuuu

SEQ ID NO: 1368 - RNA, 21 nt, Artificial Sequence
  Synthetic polynucleotide
agcugcuacugguucucucuu

SEQ ID NO: 1369 - RNA, 21 nt, Artificial Sequence
  Synthetic polynucleotide
ucccccacucccacccccauu

SEQ ID NO: 1370 - RNA, 21 nt, Artificial Sequence
  Synthetic polynucleotide
gcugcuacugguucucucguu

SEQ ID NO: 1371 - RNA, 21 nt, Artificial Sequence
  Synthetic polynucleotide
cugcuacugguucucucgcuu

SEQ ID NO: 1372 - RNA, 21 nt, Artificial Sequence
  Synthetic polynucleotide
ugcuacugguucucucgcuuu

SEQ ID NO: 1373 - RNA, 21 nt, Artificial Sequence
  Synthetic polynucleotide
gcuacugguucucucgcucuu

SEQ ID NO: 1374 - RNA, 21 nt, Artificial Sequence
  Synthetic polynucleotide
cuacugguucucucgcuccuu

SEQ ID NO: 1375 - RNA, 21 nt, Artificial Sequence
  Synthetic polynucleotide
uacugguucucucgcuccguu

SEQ ID NO: 1376 - RNA, 21 nt, Artificial Sequence
  Synthetic polynucleotide
acugguucucucgcuccgguu

SEQ ID NO: 1377 - RNA, 21 nt, Artificial Sequence
  Synthetic polynucleotide
cugguucucucgcuccggguu

SEQ ID NO: 1378 - RNA, 21 nt, Artificial Sequence
  Synthetic polynucleotide
ugguucucucgcuccgggauu

SEQ ID NO: 1379 - RNA, 21 nt, Artificial Sequence
  Synthetic polynucleotide
gguucucucgcuccgggaauu

SEQ ID NO: 1380 - RNA, 21 nt, Artificial Sequence
  Synthetic polynucleotide
cccccacucccacccccacuu

SEQ ID NO: 1381 - RNA, 21 nt, Artificial Sequence
  Synthetic polynucleotide
guucucucgcuccgggaaguu

SEQ ID NO: 1382 - RNA, 21 nt, Artificial Sequence
  Synthetic polynucleotide
uucucucgcuccgggaagguu

SEQ ID NO: 1383 - RNA, 21 nt, Artificial Sequence
  Synthetic polynucleotide
ucucucgcuccgggaaggcuu

SEQ ID NO: 1384 - RNA, 21 nt, Artificial Sequence
  Synthetic polynucleotide
cucucgcuccgggaaggccuu

SEQ ID NO: 1385 - RNA, 21 nt, Artificial Sequence
  Synthetic polynucleotide
ucucgcuccgggaaggccuuu

SEQ ID NO: 1386 - RNA, 21 nt, Artificial Sequence
  Synthetic polynucleotide
cucgcuccgggaaggccuguu

SEQ ID NO: 1387 - RNA, 21 nt, Artificial Sequence
  Synthetic polynucleotide
ucgcuccgggaaggccugguu

SEQ ID NO: 1388 - RNA, 21 nt, Artificial Sequence
  Synthetic polynucleotide
cgcuccgggaaggccuggguu

SEQ ID NO: 1389 - RNA, 21 nt, Artificial Sequence
  Synthetic polynucleotide
gcuccgggaaggccugggcuu

SEQ ID NO: 1390 - RNA, 21 nt, Artificial Sequence
  Synthetic polynucleotide
cuccgggaaggccugggcuuu

SEQ ID NO: 1391 - RNA, 21 nt, Artificial Sequence
  Synthetic polynucleotide
ccccacucccacccccacauu

SEQ ID NO: 1392 - RNA, 21 nt, Artificial Sequence
  Synthetic polynucleotide
uccgggaaggccugggcuguu

SEQ ID NO: 1393 - RNA, 21 nt, Artificial Sequence
  Synthetic polynucleotide
ccgggaaggccugggcugauu

SEQ ID NO: 1394 - RNA, 21 nt, Artificial Sequence
  Synthetic polynucleotide
cgggaaggccugggcugacuu

SEQ ID NO: 1395 - RNA, 21 nt, Artificial Sequence
  Synthetic polynucleotide
gggaaggccugggcugacguu

SEQ ID NO: 1396 - RNA, 21 nt, Artificial Sequence
  Synthetic polynucleotide
ggaaggccugggcugacgcuu

SEQ ID NO: 1397 - RNA, 21 nt, Artificial Sequence
  Synthetic polynucleotide
gaaggccugggcugacgccuu

SEQ ID NO: 1398 - RNA, 21 nt, Artificial Sequence
  Synthetic polynucleotide
aaggccugggcugacgccguu

SEQ ID NO: 1399 - RNA, 21 nt, Artificial Sequence
  Synthetic polynucleotide
aggccugggcugacgccgauu

SEQ ID NO: 1400 - RNA, 21 nt, Artificial Sequence
  Synthetic polynucleotide
ggccugggcugacgccgacuu

SEQ ID NO: 1401 - RNA, 21 nt, Artificial Sequence
  Synthetic polynucleotide
gccugggcugacgccgacauu

SEQ ID NO: 1402 - RNA, 21 nt, Artificial Sequence
  Synthetic polynucleotide
cccacucccacccccacacuu

SEQ ID NO: 1403 - RNA, 21 nt, Artificial Sequence
  Synthetic polynucleotide
ccugggcugacgccgacaauu

SEQ ID NO: 1404 - RNA, 21 nt, Artificial Sequence
  Synthetic polynucleotide
cugggcugacgccgacaacuu

SEQ ID NO: 1405 - RNA, 21 nt, Artificial Sequence
  Synthetic polynucleotide
ugggcugacgccgacaacuuu

SEQ ID NO: 1406 - RNA, 21 nt, Artificial Sequence
  Synthetic polynucleotide
gggcugacgccgacaacuauu

SEQ ID NO: 1407 - RNA, 21 nt, Artificial Sequence
  Synthetic polynucleotide
ggcugacgccgacaacuacuu

SEQ ID NO: 1408 - RNA, 21 nt, Artificial Sequence
  Synthetic polynucleotide
gcugacgccgacaacuacuuu

SEQ ID NO: 1409 - RNA, 21 nt, Artificial Sequence
  Synthetic polynucleotide
gugcacggaagagugagguuu

SEQ ID NO: 1410 - RNA, 21 nt, Artificial Sequence
  Synthetic polynucleotide
cugacgccgacaacuacuguu

SEQ ID NO: 1411 - RNA, 21 nt, Artificial Sequence
  Synthetic polynucleotide
ugacgccgacaacuacugcuu

SEQ ID NO: 1412 - RNA, 21 nt, Artificial Sequence
  Synthetic polynucleotide
gacgccgacaacuacugccuu

SEQ ID NO: 1413 - RNA, 21 nt, Artificial Sequence
  Synthetic polynucleotide
acgccgacaacuacugccguu

SEQ ID NO: 1414 - RNA, 21 nt, Artificial Sequence
  Synthetic polynucleotide
ccacucccacccccacacuuu

SEQ ID NO: 1415 - RNA, 21 nt, Artificial Sequence
  Synthetic polynucleotide
cgccgacaacuacugccgguu

SEQ ID NO: 1416 - RNA, 21 nt, Artificial Sequence
  Synthetic polynucleotide
gccgacaacuacugccggcuu

SEQ ID NO: 1417 - RNA, 21 nt, Artificial Sequence
  Synthetic polynucleotide
ccgacaacuacugccggcuuu

SEQ ID NO: 1418 - RNA, 21 nt, Artificial Sequence
  Synthetic polynucleotide
cgacaacuacugccggcuguu

SEQ ID NO: 1419 - RNA, 21 nt, Artificial Sequence
  Synthetic polynucleotide
gacaacuacugccggcugguu

SEQ ID NO: 1420 - RNA, 21 nt, Artificial Sequence
  Synthetic polynucleotide
acaacuacugccggcuggauu

SEQ ID NO: 1421 - RNA, 21 nt, Artificial Sequence
  Synthetic polynucleotide
caacuacugccggcuggaguu

SEQ ID NO: 1422 - RNA, 21 nt, Artificial Sequence
  Synthetic polynucleotide
aacuacugccggcuggagguu

SEQ ID NO: 1423 - RNA, 21 nt, Artificial Sequence
  Synthetic polynucleotide
acuacugccggcuggaggauu

SEQ ID NO: 1424 - RNA, 21 nt, Artificial Sequence
  Synthetic polynucleotide
cuacugccggcuggaggacuu

SEQ ID NO: 1425 - RNA, 21 nt, Artificial Sequence
  Synthetic polynucleotide
cacucccacccccacacucuu

SEQ ID NO: 1426 - RNA, 21 nt, Artificial Sequence
  Synthetic polynucleotide
uacugccggcuggaggacguu

SEQ ID NO: 1427 - RNA, 21 nt, Artificial Sequence
  Synthetic polynucleotide
acugccggcuggaggacgcuu

SEQ ID NO: 1428 - RNA, 21 nt, Artificial Sequence
  Synthetic polynucleotide
cugccggcuggaggacgcguu

SEQ ID NO: 1429 - RNA, 21 nt, Artificial Sequence
  Synthetic polynucleotide
ugccggcuggaggacgcgcuu

SEQ ID NO: 1430 - RNA, 21 nt, Artificial Sequence
  Synthetic polynucleotide
gccggcuggaggacgcgcauu

SEQ ID NO: 1431 - RNA, 21 nt, Artificial Sequence
  Synthetic polynucleotide
ccggcuggaggacgcgcacuu

SEQ ID NO: 1432 - RNA, 21 nt, Artificial Sequence
  Synthetic polynucleotide
cggcuggaggacgcgcaccuu

SEQ ID NO: 1433 - RNA, 21 nt, Artificial Sequence
  Synthetic polynucleotide
ggcuggaggacgcgcaccuuu

SEQ ID NO: 1434 - RNA, 21 nt, Artificial Sequence
  Synthetic polynucleotide
gcuggaggacgcgcaccuguu

SEQ ID NO: 1435 - RNA, 21 nt, Artificial Sequence
  Synthetic polynucleotide
cuggaggacgcgcaccugguu

SEQ ID NO: 1436 - RNA, 21 nt, Artificial Sequence
  Synthetic polynucleotide
acucccacccccacacuccuu

SEQ ID NO: 1437 - RNA, 21 nt, Artificial Sequence
  Synthetic polynucleotide
uggaggacgcgcaccugguuu

SEQ ID NO: 1438 - RNA, 21 nt, Artificial Sequence
  Synthetic polynucleotide
ggaggacgcgcaccugguguu

SEQ ID NO: 1439 - RNA, 21 nt, Artificial Sequence
  Synthetic polynucleotide
gaggacgcgcaccuggugguu

SEQ ID NO: 1440 - RNA, 21 nt, Artificial Sequence
  Synthetic polynucleotide
aggacgcgcaccuggugguuu

SEQ ID NO: 1441 - RNA, 21 nt, Artificial Sequence
  Synthetic polynucleotide
ggacgcgcaccuggugguguu

SEQ ID NO: 1442 - RNA, 21 nt, Artificial Sequence
  Synthetic polynucleotide
gacgcgcaccugguggugguu

SEQ ID NO: 1443 - RNA, 21 nt, Artificial Sequence
  Synthetic polynucleotide
acgcgcaccugguggugguuu

SEQ ID NO: 1444 - RNA, 21 nt, Artificial Sequence
  Synthetic polynucleotide
cgcgcaccuggugguggucuu

SEQ ID NO: 1445 - RNA, 21 nt, Artificial Sequence
  Synthetic polynucleotide
gcgcaccuggugguggucauu

SEQ ID NO: 1446 - RNA, 21 nt, Artificial Sequence
  Synthetic polynucleotide
cgcaccuggugguggucacuu

SEQ ID NO: 1447 - RNA, 21 nt, Artificial Sequence
  Synthetic polynucleotide
cucccacccccacacucccuu

SEQ ID NO: 1448 - RNA, 21 nt, Artificial Sequence
  Synthetic polynucleotide
gcaccuggugguggucacguu

SEQ ID NO: 1449 - RNA, 21 nt, Artificial Sequence
  Synthetic polynucleotide
caccuggugguggucacguuu

SEQ ID NO: 1450 - RNA, 21 nt, Artificial Sequence
  Synthetic polynucleotide
accuggugguggucacgucuu

SEQ ID NO: 1451 - RNA, 21 nt, Artificial Sequence
  Synthetic polynucleotide
ccuggugguggucacguccuu

SEQ ID NO: 1452 - RNA, 21 nt, Artificial Sequence
  Synthetic polynucleotide
cuggugguggucacguccuuu

SEQ ID NO: 1453 - RNA, 21 nt, Artificial Sequence
  Synthetic polynucleotide
uggugguggucacguccuguu

SEQ ID NO: 1454 - RNA, 21 nt, Artificial Sequence
  Synthetic polynucleotide
ggugguggucacguccugguu

SEQ ID NO: 1455 - RNA, 21 nt, Artificial Sequence
  Synthetic polynucleotide
gugguggucacguccuggguu

SEQ ID NO: 1456 - RNA, 21 nt, Artificial Sequence
  Synthetic polynucleotide
ugguggucacguccugggauu

SEQ ID NO: 1457 - RNA, 21 nt, Artificial Sequence
  Synthetic polynucleotide
gguggucacguccugggaguu

SEQ ID NO: 1458 - RNA, 21 nt, Artificial Sequence
  Synthetic polynucleotide
ucccacccccacacuccccuu

SEQ ID NO: 1459 - RNA, 21 nt, Artificial Sequence
  Synthetic polynucleotide
guggucacguccugggagguu

SEQ ID NO: 1460 - RNA, 21 nt, Artificial Sequence
  Synthetic polynucleotide
uggucacguccugggaggauu

SEQ ID NO: 1461 - RNA, 21 nt, Artificial Sequence
  Synthetic polynucleotide
ggucacguccugggaggaguu

SEQ ID NO: 1462 - RNA, 21 nt, Artificial Sequence
  Synthetic polynucleotide
gucacguccugggaggagcuu

SEQ ID NO: 1463 - RNA, 21 nt, Artificial Sequence
  Synthetic polynucleotide
ucacguccugggaggagcauu

SEQ ID NO: 1464 - RNA, 21 nt, Artificial Sequence
  Synthetic polynucleotide
cacguccugggaggagcaguu

SEQ ID NO: 1465 - RNA, 21 nt, Artificial Sequence
  Synthetic polynucleotide
acguccugggaggagcagauu

SEQ ID NO: 1466 - RNA, 21 nt, Artificial Sequence
  Synthetic polynucleotide
cguccugggaggagcagaauu

SEQ ID NO: 1467 - RNA, 21 nt, Artificial Sequence
  Synthetic polynucleotide
guccugggaggagcagaaauu

SEQ ID NO: 1468 - RNA, 21 nt, Artificial Sequence
  Synthetic polynucleotide
uccugggaggagcagaaauuu

SEQ ID NO: 1469 - RNA, 21 nt, Artificial Sequence
  Synthetic polynucleotide
cccacccccacacuccccuuu

SEQ ID NO: 1470 - RNA, 21 nt, Artificial Sequence
  Synthetic polynucleotide
ccugggaggagcagaaauuuu

SEQ ID NO: 1471 - RNA, 21 nt, Artificial Sequence
  Synthetic polynucleotide
cugggaggagcagaaauuuuu

SEQ ID NO: 1472 - RNA, 21 nt, Artificial Sequence
  Synthetic polynucleotide
ugggaggagcagaaauuuguu

SEQ ID NO: 1473 - RNA, 21 nt, Artificial Sequence
  Synthetic polynucleotide
gggaggagcagaaauuuguuu

SEQ ID NO: 1474 - RNA, 21 nt, Artificial Sequence
  Synthetic polynucleotide
ggaggagcagaaauuugucuu

SEQ ID NO: 1475 - RNA, 21 nt, Artificial Sequence
  Synthetic polynucleotide
gaggagcagaaauuuguccuu

SEQ ID NO: 1476 - RNA, 21 nt, Artificial Sequence
  Synthetic polynucleotide
aggagcagaaauuuguccauu

SEQ ID NO: 1477 - RNA, 21 nt, Artificial Sequence
  Synthetic polynucleotide
ggagcagaaauuuguccaguu

SEQ ID NO: 1478 - RNA, 21 nt, Artificial Sequence
  Synthetic polynucleotide
gagcagaaauuuguccagcuu

SEQ ID NO: 1479 - RNA, 21 nt, Artificial Sequence
  Synthetic polynucleotide
agcagaaauuuguccagcauu

SEQ ID NO: 1480 - RNA, 21 nt, Artificial Sequence
  Synthetic polynucleotide
gcagaaauuuguccagcacuu

SEQ ID NO: 1481 - RNA, 21 nt, Artificial Sequence
  Synthetic polynucleotide
ccacccccacacuccccuauu

SEQ ID NO: 1482 - RNA, 21 nt, Artificial Sequence
  Synthetic polynucleotide
cagaaauuuguccagcaccuu

SEQ ID NO: 1483 - RNA, 21 nt, Artificial Sequence
  Synthetic polynucleotide
agaaauuuguccagcaccauu

SEQ ID NO: 1484 - RNA, 21 nt, Artificial Sequence
  Synthetic polynucleotide
gaaauuuguccagcaccacuu

SEQ ID NO: 1485 - RNA, 21 nt, Artificial Sequence
  Synthetic polynucleotide
aaauuuguccagcaccacauu

SEQ ID NO: 1486 - RNA, 21 nt, Artificial Sequence
  Synthetic polynucleotide
aauuuguccagcaccacauuu

SEQ ID NO: 1487 - RNA, 21 nt, Artificial Sequence
  Synthetic polynucleotide
auuuguccagcaccacauauu

SEQ ID NO: 1488 - RNA, 21 nt, Artificial Sequence
  Synthetic polynucleotide
uuuguccagcaccacauaguu

SEQ ID NO: 1489 - RNA, 21 nt, Artificial Sequence
  Synthetic polynucleotide
uuguccagcaccacauagguu

SEQ ID NO: 1490 - RNA, 21 nt, Artificial Sequence
  Synthetic polynucleotide
accaucagcucagaaaagauu

SEQ ID NO: 1491 - RNA, 21 nt, Artificial Sequence
  Synthetic polynucleotide
ccaucagcucagaaaagacuu

SEQ ID NO: 1492 - RNA, 21 nt, Artificial Sequence
  Synthetic polynucleotide
caucagcucagaaaagacuuu

SEQ ID NO: 1493 - RNA, 21 nt, Artificial Sequence
  Synthetic polynucleotide
aucagcucagaaaagacucuu

SEQ ID NO: 1494 - RNA, 21 nt, Artificial Sequence
  Synthetic polynucleotide
ucagcucagaaaagacuccuu

SEQ ID NO: 1495 - RNA, 21 nt, Artificial Sequence
  Synthetic polynucleotide
cagcucagaaaagacucccuu

SEQ ID NO: 1496 - RNA, 21 nt, Artificial Sequence
  Synthetic polynucleotide
agcucagaaaagacucccauu

SEQ ID NO: 1497 - RNA, 21 nt, Artificial Sequence
  Synthetic polynucleotide
gcucagaaaagacucccaguu

SEQ ID NO: 1498 - RNA, 21 nt, Artificial Sequence
  Synthetic polynucleotide
cucagaaaagacucccagcuu

SEQ ID NO: 1499 - RNA, 21 nt, Artificial Sequence
  Synthetic polynucleotide
ucagaaaagacucccagcuuu

SEQ ID NO: 1500 - RNA, 21 nt, Artificial Sequence
  Synthetic polynucleotide
cagaaaagacucccagcuguu

SEQ ID NO: 1501 - RNA, 21 nt, Artificial Sequence
  Synthetic polynucleotide
agaaaagacucccagcugcuu

SEQ ID NO: 1502 - RNA, 21 nt, Artificial Sequence
  Synthetic polynucleotide
gaaaagacucccagcugcauu

SEQ ID NO: 1503 - RNA, 21 nt, Artificial Sequence
  Synthetic polynucleotide
aaaagacucccagcugcaguu

SEQ ID NO: 1504 - RNA, 21 nt, Artificial Sequence
  Synthetic polynucleotide
aaagacucccagcugcagguu

SEQ ID NO: 1505 - RNA, 21 nt, Artificial Sequence
  Synthetic polynucleotide
aagacucccagcugcaggauu

SEQ ID NO: 1506 - RNA, 21 nt, Artificial Sequence
  Synthetic polynucleotide
agacucccagcugcaggaguu

SEQ ID NO: 1507 - RNA, 21 nt, Artificial Sequence
  Synthetic polynucleotide
gacucccagcugcaggagguu

SEQ ID NO: 1508 - RNA, 21 nt, Artificial Sequence
  Synthetic polynucleotide
gccuauguggugcuggacauu

SEQ ID NO: 1509 - RNA, 21 nt, Artificial Sequence
  Synthetic polynucleotide
ggccuauguggugcuggacuu

SEQ ID NO: 1510 - RNA, 21 nt, Artificial Sequence
  Synthetic polynucleotide
uuaggggaguguggggguguu

SEQ ID NO: 1511 - RNA, 21 nt, Artificial Sequence
  Synthetic polynucleotide
gggccuauguggugcuggauu

SEQ ID NO: 1512 - RNA, 21 nt, Artificial Sequence
  Synthetic polynucleotide
agggccuauguggugcugguu

SEQ ID NO: 1513 - RNA, 21 nt, Artificial Sequence
  Synthetic polynucleotide
cagggccuauguggugcuguu

SEQ ID NO: 1514 - RNA, 21 nt, Artificial Sequence
  Synthetic polynucleotide
acagggccuauguggugcuuu

SEQ ID NO: 1515 - RNA, 21 nt, Artificial Sequence
  Synthetic polynucleotide
cacagggccuauguggugcuu

SEQ ID NO: 1516 - RNA, 21 nt, Artificial Sequence
  Synthetic polynucleotide
ucacagggccuaugugguguu

SEQ ID NO: 1517 - RNA, 21 nt, Artificial Sequence
  Synthetic polynucleotide
uucacagggccuaugugguuu

SEQ ID NO: 1518 - RNA, 21 nt, Artificial Sequence
  Synthetic polynucleotide
guucacagggccuaugugguu

SEQ ID NO: 1519 - RNA, 21 nt, Artificial Sequence
  Synthetic polynucleotide
uguucacagggccuauguguu

SEQ ID NO: 1520 - RNA, 21 nt, Artificial Sequence
  Synthetic polynucleotide
guguucacagggccuauguuu

SEQ ID NO: 1521 - RNA, 21 nt, Artificial Sequence
  Synthetic polynucleotide
cuuaggggaguguggggguuu

SEQ ID NO: 1522 - RNA, 21 nt, Artificial Sequence
  Synthetic polynucleotide
gguguucacagggccuauguu

SEQ ID NO: 1523 - RNA, 21 nt, Artificial Sequence
  Synthetic polynucleotide
agguguucacagggccuauuu

SEQ ID NO: 1524 - RNA, 21 nt, Artificial Sequence
  Synthetic polynucleotide
cagguguucacagggccuauu

SEQ ID NO: 1525 - RNA, 21 nt, Artificial Sequence
  Synthetic polynucleotide
ccagguguucacagggccuuu

SEQ ID NO: 1526 - RNA, 21 nt, Artificial Sequence
  Synthetic polynucleotide
uccagguguucacagggccuu

SEQ ID NO: 1527 - RNA, 21 nt, Artificial Sequence
  Synthetic polynucleotide
auccagguguucacagggcuu

SEQ ID NO: 1528 - RNA, 21 nt, Artificial Sequence
  Synthetic polynucleotide
cauccagguguucacaggguu

SEQ ID NO: 1529 - RNA, 21 nt, Artificial Sequence
  Synthetic polynucleotide
ccauccagguguucacagguu

SEQ ID NO: 1530 - RNA, 21 nt, Artificial Sequence
  Synthetic polynucleotide
cccauccagguguucacaguu

SEQ ID NO: 1531 - RNA, 21 nt, Artificial Sequence
  Synthetic polynucleotide
gcccauccagguguucacauu

SEQ ID NO: 1532 - RNA, 21 nt, Artificial Sequence
  Synthetic polynucleotide
acuuaggggaguguggggguu

SEQ ID NO: 1533 - RNA, 21 nt, Artificial Sequence
  Synthetic polynucleotide
ggcccauccagguguucacuu

SEQ ID NO: 1534 - RNA, 21 nt, Artificial Sequence
  Synthetic polynucleotide
aggcccauccagguguucauu

SEQ ID NO: 1535 - RNA, 21 nt, Artificial Sequence
  Synthetic polynucleotide
gaggcccauccagguguucuu

SEQ ID NO: 1536 - RNA, 21 nt, Artificial Sequence
  Synthetic polynucleotide
ggaggcccauccagguguuuu

SEQ ID NO: 1537 - RNA, 21 nt, Artificial Sequence
  Synthetic polynucleotide
uggaggcccauccagguguuu

SEQ ID NO: 1538 - RNA, 21 nt, Artificial Sequence
  Synthetic polynucleotide
guggaggcccauccagguguu

SEQ ID NO: 1539 - RNA, 21 nt, Artificial Sequence
  Synthetic polynucleotide
caccucacucuuccgugcauu

SEQ ID NO: 1540 - RNA, 21 nt, Artificial Sequence
  Synthetic polynucleotide
cguggaggcccauccagguuu

SEQ ID NO: 1541 - RNA, 21 nt, Artificial Sequence
  Synthetic polynucleotide
ucguggaggcccauccagguu

SEQ ID NO: 1542 - RNA, 21 nt, Artificial Sequence
  Synthetic polynucleotide
gucguggaggcccauccaguu

SEQ ID NO: 1543 - RNA, 21 nt, Artificial Sequence
  Synthetic polynucleotide
ggucguggaggcccauccauu

SEQ ID NO: 1544 - RNA, 21 nt, Artificial Sequence
  Synthetic polynucleotide
aacuuaggggagugugggguu

SEQ ID NO: 1545 - RNA, 21 nt, Artificial Sequence
  Synthetic polynucleotide
uggucguggaggcccauccuu

SEQ ID NO: 1546 - RNA, 21 nt, Artificial Sequence
  Synthetic polynucleotide
uuggucguggaggcccaucuu

SEQ ID NO: 1547 - RNA, 21 nt, Artificial Sequence
  Synthetic polynucleotide
uuuggucguggaggcccauuu

SEQ ID NO: 1548 - RNA, 21 nt, Artificial Sequence
  Synthetic polynucleotide
uuuuggucguggaggcccauu

SEQ ID NO: 1549 - RNA, 21 nt, Artificial Sequence
  Synthetic polynucleotide
guuuuggucguggaggcccuu

SEQ ID NO: 1550 - RNA, 21 nt, Artificial Sequence
  Synthetic polynucleotide
cguuuuggucguggaggccuu

SEQ ID NO: 1551 - RNA, 21 nt, Artificial Sequence
  Synthetic polynucleotide
ccguuuuggucguggaggcuu

SEQ ID NO: 1552 - RNA, 21 nt, Artificial Sequence
  Synthetic polynucleotide
cccguuuuggucguggagguu

SEQ ID NO: 1553 - RNA, 21 nt, Artificial Sequence
  Synthetic polynucleotide
gcccguuuuggucguggaguu

SEQ ID NO: 1554 - RNA, 21 nt, Artificial Sequence
  Synthetic polynucleotide
ggcccguuuuggucguggauu

SEQ ID NO: 1555 - RNA, 21 nt, Artificial Sequence
  Synthetic polynucleotide
gaacuuaggggaguguggguu

SEQ ID NO: 1556 - RNA, 21 nt, Artificial Sequence
  Synthetic polynucleotide
gggcccguuuuggucgugguu

SEQ ID NO: 1557 - RNA, 21 nt, Artificial Sequence
  Synthetic polynucleotide
agggcccguuuuggucguguu

SEQ ID NO: 1558 - RNA, 21 nt, Artificial Sequence
  Synthetic polynucleotide
cagggcccguuuuggucguuu

SEQ ID NO: 1559 - RNA, 21 nt, Artificial Sequence
  Synthetic polynucleotide
ccagggcccguuuuggucguu

SEQ ID NO: 1560 - RNA, 21 nt, Artificial Sequence
  Synthetic polynucleotide
uccagggcccguuuuggucuu

SEQ ID NO: 1561 - RNA, 21 nt, Artificial Sequence
  Synthetic polynucleotide
uuccagggcccguuuugguuu

SEQ ID NO: 1562 - RNA, 21 nt, Artificial Sequence
  Synthetic polynucleotide
cuuccagggcccguuuugguu

SEQ ID NO: 1563 - RNA, 21 nt, Artificial Sequence
  Synthetic polynucleotide
acuuccagggcccguuuuguu

SEQ ID NO: 1564 - RNA, 21 nt, Artificial Sequence
  Synthetic polynucleotide
cacuuccagggcccguuuuuu

SEQ ID NO: 1565 - RNA, 21 nt, Artificial Sequence
  Synthetic polynucleotide
ccacuuccagggcccguuuuu

SEQ ID NO: 1566 - RNA, 21 nt, Artificial Sequence
  Synthetic polynucleotide
ggaacuuaggggagugugguu

SEQ ID NO: 1567 - RNA, 21 nt, Artificial Sequence
  Synthetic polynucleotide
cccacuuccagggcccguuuu

SEQ ID NO: 1568 - RNA, 21 nt, Artificial Sequence
  Synthetic polynucleotide
acccacuuccagggcccguuu

SEQ ID NO: 1569 - RNA, 21 nt, Artificial Sequence
  Synthetic polynucleotide
cacccacuuccagggcccguu

SEQ ID NO: 1570 - RNA, 21 nt, Artificial Sequence
  Synthetic polynucleotide
ccacccacuuccagggcccuu

SEQ ID NO: 1571 - RNA, 21 nt, Artificial Sequence
  Synthetic polynucleotide
uccacccacuuccagggccuu

SEQ ID NO: 1572 - RNA, 21 nt, Artificial Sequence
  Synthetic polynucleotide
guccacccacuuccagggcuu

SEQ ID NO: 1573 - RNA, 21 nt, Artificial Sequence
  Synthetic polynucleotide
cguccacccacuuccaggguu

SEQ ID NO: 1574 - RNA, 21 nt, Artificial Sequence
  Synthetic polynucleotide
ccguccacccacuuccagguu

SEQ ID NO: 1575 - RNA, 21 nt, Artificial Sequence
  Synthetic polynucleotide
cccguccacccacuuccaguu

SEQ ID NO: 1576 - RNA, 21 nt, Artificial Sequence
  Synthetic polynucleotide
ucccguccacccacuuccauu

SEQ ID NO: 1577 - RNA, 21 nt, Artificial Sequence
  Synthetic polynucleotide
uggaacuuaggggaguguguu

SEQ ID NO: 1578 - RNA, 21 nt, Artificial Sequence
  Synthetic polynucleotide
gucccguccacccacuuccuu

SEQ ID NO: 1579 - RNA, 21 nt, Artificial Sequence
  Synthetic polynucleotide
cgucccguccacccacuucuu

SEQ ID NO: 1580 - RNA, 21 nt, Artificial Sequence
  Synthetic polynucleotide
ccgucccguccacccacuuuu

SEQ ID NO: 1581 - RNA, 21 nt, Artificial Sequence
  Synthetic polynucleotide
uccgucccguccacccacuuu

SEQ ID NO: 1582 - RNA, 21 nt, Artificial Sequence
  Synthetic polynucleotide
guccgucccguccacccacuu

SEQ ID NO: 1583 - RNA, 21 nt, Artificial Sequence
  Synthetic polynucleotide
aguccgucccguccacccauu

SEQ ID NO: 1584 - RNA, 21 nt, Artificial Sequence
  Synthetic polynucleotide
uaguccgucccguccacccuu

SEQ ID NO: 1585 - RNA, 21 nt, Artificial Sequence
  Synthetic polynucleotide
guaguccgucccguccaccuu

SEQ ID NO: 1586 - RNA, 21 nt, Artificial Sequence
  Synthetic polynucleotide
cguaguccgucccguccacuu

SEQ ID NO: 1587 - RNA, 21 nt, Artificial Sequence
  Synthetic polynucleotide
ucguaguccgucccguccauu

SEQ ID NO: 1588 - RNA, 21 nt, Artificial Sequence
  Synthetic polynucleotide
uuggaacuuaggggaguguuu

SEQ ID NO: 1589 - RNA, 21 nt, Artificial Sequence
  Synthetic polynucleotide
cucguaguccgucccguccuu

SEQ ID NO: 1590 - RNA, 21 nt, Artificial Sequence
  Synthetic polynucleotide
ucucguaguccgucccgucuu

SEQ ID NO: 1591 - RNA, 21 nt, Artificial Sequence
  Synthetic polynucleotide
gucucguaguccgucccguuu

SEQ ID NO: 1592 - RNA, 21 nt, Artificial Sequence
  Synthetic polynucleotide
cgucucguaguccgucccguu

SEQ ID NO: 1593 - RNA, 21 nt, Artificial Sequence
  Synthetic polynucleotide
ccgucucguaguccgucccuu

SEQ ID NO: 1594 - RNA, 21 nt, Artificial Sequence
  Synthetic polynucleotide
cccgucucguaguccguccuu

SEQ ID NO: 1595 - RNA, 21 nt, Artificial Sequence
  Synthetic polynucleotide
gcccgucucguaguccgucuu

SEQ ID NO: 1596 - RNA, 21 nt, Artificial Sequence
  Synthetic polynucleotide
agcccgucucguaguccguuu

SEQ ID NO: 1597 - RNA, 21 nt, Artificial Sequence
  Synthetic polynucleotide
aagcccgucucguaguccguu

SEQ ID NO: 1598 - RNA, 21 nt, Artificial Sequence
  Synthetic polynucleotide
gaagcccgucucguaguccuu

SEQ ID NO: 1599 - RNA, 21 nt, Artificial Sequence
  Synthetic polynucleotide
auuggaacuuaggggaguguu

SEQ ID NO: 1600 - RNA, 21 nt, Artificial Sequence
  Synthetic polynucleotide
ugaagcccgucucguagucuu

SEQ ID NO: 1601 - RNA, 21 nt, Artificial Sequence
  Synthetic polynucleotide
uugaagcccgucucguaguuu

SEQ ID NO: 1602 - RNA, 21 nt, Artificial Sequence
  Synthetic polynucleotide
cuugaagcccgucucguaguu

SEQ ID NO: 1603 - RNA, 21 nt, Artificial Sequence
  Synthetic polynucleotide
ucuugaagcccgucucguauu

SEQ ID NO: 1604 - RNA, 21 nt, Artificial Sequence
  Synthetic polynucleotide
uucuugaagcccgucucguuu

SEQ ID NO: 1605 - RNA, 21 nt, Artificial Sequence
  Synthetic polynucleotide
guucuugaagcccgucucguu

SEQ ID NO: 1606 - RNA, 21 nt, Artificial Sequence
  Synthetic polynucleotide
aguucuugaagcccgucucuu

SEQ ID NO: 1607 - RNA, 21 nt, Artificial Sequence
  Synthetic polynucleotide
caguucuugaagcccgucuuu

SEQ ID NO: 1608 - RNA, 21 nt, Artificial Sequence
  Synthetic polynucleotide
ccaguucuugaagcccgucuu

SEQ ID NO: 1609 - RNA, 21 nt, Artificial Sequence
  Synthetic polynucleotide
uccaguucuugaagcccguuu

SEQ ID NO: 1610 - RNA, 21 nt, Artificial Sequence
  Synthetic polynucleotide
gauuggaacuuaggggaguuu

SEQ ID NO: 1611 - RNA, 21 nt, Artificial Sequence
  Synthetic polynucleotide
cuccaguucuugaagcccguu

SEQ ID NO: 1612 - RNA, 21 nt, Artificial Sequence
  Synthetic polynucleotide
ccuccaguucuugaagcccuu

SEQ ID NO: 1613 - RNA, 21 nt, Artificial Sequence
  Synthetic polynucleotide
gccuccaguucuugaagccuu

SEQ ID NO: 1614 - RNA, 21 nt, Artificial Sequence
  Synthetic polynucleotide
ggccuccaguucuugaagcuu

SEQ ID NO: 1615 - RNA, 21 nt, Artificial Sequence
  Synthetic polynucleotide
cggccuccaguucuugaaguu

SEQ ID NO: 1616 - RNA, 21 nt, Artificial Sequence
  Synthetic polynucleotide
ccggccuccaguucuugaauu

SEQ ID NO: 1617 - RNA, 21 nt, Artificial Sequence
  Synthetic polynucleotide
uccggccuccaguucuugauu

SEQ ID NO: 1618 - RNA, 21 nt, Artificial Sequence
  Synthetic polynucleotide
cuccggccuccaguucuuguu

SEQ ID NO: 1619 - RNA, 21 nt, Artificial Sequence
  Synthetic polynucleotide
gcuccggccuccaguucuuuu

SEQ ID NO: 1620 - RNA, 21 nt, Artificial Sequence
  Synthetic polynucleotide
ugcuccggccuccaguucuuu

SEQ ID NO: 1621 - RNA, 21 nt, Artificial Sequence
  Synthetic polynucleotide
ggauuggaacuuaggggaguu

SEQ ID NO: 1622 - RNA, 21 nt, Artificial Sequence
  Synthetic polynucleotide
cugcuccggccuccaguucuu

SEQ ID NO: 1623 - RNA, 21 nt, Artificial Sequence
  Synthetic polynucleotide
gcugcuccggccuccaguuuu

SEQ ID NO: 1624 - RNA, 21 nt, Artificial Sequence
  Synthetic polynucleotide
ggcugcuccggccuccaguuu

SEQ ID NO: 1625 - RNA, 21 nt, Artificial Sequence
  Synthetic polynucleotide
cggcugcuccggccuccaguu

SEQ ID NO: 1626 - RNA, 21 nt, Artificial Sequence
  Synthetic polynucleotide
ccggcugcuccggccuccauu

SEQ ID NO: 1627 - RNA, 21 nt, Artificial Sequence
  Synthetic polynucleotide
uccggcugcuccggccuccuu

SEQ ID NO: 1628 - RNA, 21 nt, Artificial Sequence
  Synthetic polynucleotide
guccggcugcuccggccucuu

SEQ ID NO: 1629 - RNA, 21 nt, Artificial Sequence
  Synthetic polynucleotide
cguccggcugcuccggccuuu

SEQ ID NO: 1630 - RNA, 21 nt, Artificial Sequence
  Synthetic polynucleotide
ucguccggcugcuccggccuu

SEQ ID NO: 1631 - RNA, 21 nt, Artificial Sequence
  Synthetic polynucleotide
gucguccggcugcuccggcuu

SEQ ID NO: 1632 - RNA, 21 nt, Artificial Sequence
  Synthetic polynucleotide
uggauuggaacuuaggggauu

SEQ ID NO: 1633 - RNA, 21 nt, Artificial Sequence
  Synthetic polynucleotide
agucguccggcugcuccgguu

SEQ ID NO: 1634 - RNA, 21 nt, Artificial Sequence
  Synthetic polynucleotide
cagucguccggcugcuccguu

SEQ ID NO: 1635 - RNA, 21 nt, Artificial Sequence
  Synthetic polynucleotide
ccagucguccggcugcuccuu

SEQ ID NO: 1636 - RNA, 21 nt, Artificial Sequence
  Synthetic polynucleotide
accagucguccggcugcucuu

SEQ ID NO: 1637 - RNA, 21 nt, Artificial Sequence
  Synthetic polynucleotide
uaccagucguccggcugcuuu

SEQ ID NO: 1638 - RNA, 21 nt, Artificial Sequence
  Synthetic polynucleotide
guaccagucguccggcugcuu

SEQ ID NO: 1639 - RNA, 21 nt, Artificial Sequence
  Synthetic polynucleotide
cguaccagucguccggcuguu

SEQ ID NO: 1640 - RNA, 21 nt, Artificial Sequence
  Synthetic polynucleotide
ccguaccagucguccggcuuu

SEQ ID NO: 1641 - RNA, 21 nt, Artificial Sequence
  Synthetic polynucleotide
gccguaccagucguccggcuu

SEQ ID NO: 1642 - RNA, 21 nt, Artificial Sequence
  Synthetic polynucleotide
ggccguaccagucguccgguu

SEQ ID NO: 1643 - RNA, 21 nt, Artificial Sequence
  Synthetic polynucleotide
auggauuggaacuuagggguu

SEQ ID NO: 1644 - RNA, 21 nt, Artificial Sequence
  Synthetic polynucleotide
uggccguaccagucguccguu

SEQ ID NO: 1645 - RNA, 21 nt, Artificial Sequence
  Synthetic polynucleotide
guggccguaccagucguccuu

SEQ ID NO: 1646 - RNA, 21 nt, Artificial Sequence
  Synthetic polynucleotide
cguggccguaccagucgucuu

SEQ ID NO: 1647 - RNA, 21 nt, Artificial Sequence
  Synthetic polynucleotide
ccguggccguaccagucguuu

SEQ ID NO: 1648 - RNA, 21 nt, Artificial Sequence
  Synthetic polynucleotide
cccguggccguaccagucguu

SEQ ID NO: 1649 - RNA, 21 nt, Artificial Sequence
  Synthetic polynucleotide
gcccguggccguaccagucuu

SEQ ID NO: 1650 - RNA, 21 nt, Artificial Sequence
  Synthetic polynucleotide
agcccguggccguaccaguuu

SEQ ID NO: 1651 - RNA, 21 nt, Artificial Sequence
  Synthetic polynucleotide
ucaccucacucuuccgugcuu

SEQ ID NO: 1652 - RNA, 21 nt, Artificial Sequence
  Synthetic polynucleotide
gagcccguggccguaccaguu

SEQ ID NO: 1653 - RNA, 21 nt, Artificial Sequence
  Synthetic polynucleotide
cgagcccguggccguaccauu

SEQ ID NO: 1654 - RNA, 21 nt, Artificial Sequence
  Synthetic polynucleotide
ccgagcccguggccguaccuu

SEQ ID NO: 1655 - RNA, 21 nt, Artificial Sequence
  Synthetic polynucleotide
aauggauuggaacuuaggguu

SEQ ID NO: 1656 - RNA, 21 nt, Artificial Sequence
  Synthetic polynucleotide
uccgagcccguggccguacuu

SEQ ID NO: 1657 - RNA, 21 nt, Artificial Sequence
  Synthetic polynucleotide
cuccgagcccguggccguauu

SEQ ID NO: 1658 - RNA, 21 nt, Artificial Sequence
  Synthetic polynucleotide
ccuccgagcccguggccguuu

SEQ ID NO: 1659 - RNA, 21 nt, Artificial Sequence
  Synthetic polynucleotide
uccuccgagcccguggccguu

SEQ ID NO: 1660 - RNA, 21 nt, Artificial Sequence
  Synthetic polynucleotide
cuccuccgagcccguggccuu

SEQ ID NO: 1661 - RNA, 21 nt, Artificial Sequence
  Synthetic polynucleotide
ccuccuccgagcccguggcuu

SEQ ID NO: 1662 - RNA, 21 nt, Artificial Sequence
  Synthetic polynucleotide
gccuccuccgagcccgugguu

SEQ ID NO: 1663 - RNA, 21 nt, Artificial Sequence
  Synthetic polynucleotide
cgccuccuccgagcccguguu

SEQ ID NO: 1664 - RNA, 21 nt, Artificial Sequence
  Synthetic polynucleotide
ucgccuccuccgagcccguuu

SEQ ID NO: 1665 - RNA, 21 nt, Artificial Sequence
  Synthetic polynucleotide
cucgccuccuccgagcccguu

SEQ ID NO: 1666 - RNA, 21 nt, Artificial Sequence
  Synthetic polynucleotide
aaauggauuggaacuuagguu

SEQ ID NO: 1667 - RNA, 21 nt, Artificial Sequence
  Synthetic polynucleotide
ccucgccuccuccgagcccuu

SEQ ID NO: 1668 - RNA, 21 nt, Artificial Sequence
  Synthetic polynucleotide
uccucgccuccuccgagccuu

SEQ ID NO: 1669 - RNA, 21 nt, Artificial Sequence
  Synthetic polynucleotide
guccucgccuccuccgagcuu

SEQ ID NO: 1670 - RNA, 21 nt, Artificial Sequence
  Synthetic polynucleotide
aguccucgccuccuccgaguu

SEQ ID NO: 1671 - RNA, 21 nt, Artificial Sequence
  Synthetic polynucleotide
caguccucgccuccuccgauu

SEQ ID NO: 1672 - RNA, 21 nt, Artificial Sequence
  Synthetic polynucleotide
acaguccucgccuccuccguu

SEQ ID NO: 1673 - RNA, 21 nt, Artificial Sequence
  Synthetic polynucleotide
cacaguccucgccuccuccuu

SEQ ID NO: 1674 - RNA, 21 nt, Artificial Sequence
  Synthetic polynucleotide
gcacaguccucgccuccucuu

SEQ ID NO: 1675 - RNA, 21 nt, Artificial Sequence
  Synthetic polynucleotide
ggcacaguccucgccuccuuu

SEQ ID NO: 1676 - RNA, 21 nt, Artificial Sequence
  Synthetic polynucleotide
gggcacaguccucgccuccuu

SEQ ID NO: 1677 - RNA, 21 nt, Artificial Sequence
  Synthetic polynucleotide
gaaauggauuggaacuuaguu

SEQ ID NO: 1678 - RNA, 21 nt, Artificial Sequence
  Synthetic polynucleotide
ugggcacaguccucgccucuu

SEQ ID NO: 1679 - RNA, 21 nt, Artificial Sequence
  Synthetic polynucleotide
gugggcacaguccucgccuuu

SEQ ID NO: 1680 - RNA, 21 nt, Artificial Sequence
  Synthetic polynucleotide
agugggcacaguccucgccuu

SEQ ID NO: 1681 - RNA, 21 nt, Artificial Sequence
  Synthetic polynucleotide
aagugggcacaguccucgcuu

SEQ ID NO: 1682 - RNA, 21 nt, Artificial Sequence
  Synthetic polynucleotide
gaagugggcacaguccucguu

SEQ ID NO: 1683 - RNA, 21 nt, Artificial Sequence
  Synthetic polynucleotide
ugaagugggcacaguccucuu

SEQ ID NO: 1684 - RNA, 21 nt, Artificial Sequence
  Synthetic polynucleotide
gugaagugggcacaguccuuu

SEQ ID NO: 1685 - RNA, 21 nt, Artificial Sequence
  Synthetic polynucleotide
ggugaagugggcacaguccuu

SEQ ID NO: 1686 - RNA, 21 nt, Artificial Sequence
  Synthetic polynucleotide
cggugaagugggcacagucuu

SEQ ID NO: 1687 - RNA, 21 nt, Artificial Sequence
  Synthetic polynucleotide
ucggugaagugggcacaguuu

SEQ ID NO: 1688 - RNA, 21 nt, Artificial Sequence
  Synthetic polynucleotide
ggaaauggauuggaacuuauu

SEQ ID NO: 1689 - RNA, 21 nt, Artificial Sequence
  Synthetic polynucleotide
gucggugaagugggcacaguu

SEQ ID NO: 1690 - RNA, 21 nt, Artificial Sequence
  Synthetic polynucleotide
cgucggugaagugggcacauu

SEQ ID NO: 1691 - RNA, 21 nt, Artificial Sequence
  Synthetic polynucleotide
ucgucggugaagugggcacuu

SEQ ID NO: 1692 - RNA, 21 nt, Artificial Sequence
  Synthetic polynucleotide
gucgucggugaagugggcauu

SEQ ID NO: 1693 - RNA, 21 nt, Artificial Sequence
  Synthetic polynucleotide
cgucgucggugaagugggcuu

SEQ ID NO: 1694 - RNA, 21 nt, Artificial Sequence
  Synthetic polynucleotide
ccgucgucggugaaguggguu

SEQ ID NO: 1695 - RNA, 21 nt, Artificial Sequence
  Synthetic polynucleotide
gccgucgucggugaagugguu

SEQ ID NO: 1696 - RNA, 21 nt, Artificial Sequence
  Synthetic polynucleotide
ggccgucgucggugaaguguu

SEQ ID NO: 1697 - RNA, 21 nt, Artificial Sequence
  Synthetic polynucleotide
cggccgucgucggugaaguuu

SEQ ID NO: 1698 - RNA, 21 nt, Artificial Sequence
  Synthetic polynucleotide
gcggccgucgucggugaaguu

SEQ ID NO: 1699 - RNA, 21 nt, Artificial Sequence
  Synthetic polynucleotide
uggaaauggauuggaacuuuu

SEQ ID NO: 1700 - RNA, 21 nt, Artificial Sequence
  Synthetic polynucleotide
agcggccgucgucggugaauu

SEQ ID NO: 1701 - RNA, 21 nt, Artificial Sequence
  Synthetic polynucleotide
cagcggccgucgucggugauu

SEQ ID NO: 1702 - RNA, 21 nt, Artificial Sequence
  Synthetic polynucleotide
ccagcggccgucgucgguguu

SEQ ID NO: 1703 - RNA, 21 nt, Artificial Sequence
  Synthetic polynucleotide
uccagcggccgucgucgguuu

SEQ ID NO: 1704 - RNA, 21 nt, Artificial Sequence
  Synthetic polynucleotide
uuccagcggccgucgucgguu

SEQ ID NO: 1705 - RNA, 21 nt, Artificial Sequence
  Synthetic polynucleotide
guuccagcggccgucgucguu

SEQ ID NO: 1706 - RNA, 21 nt, Artificial Sequence
  Synthetic polynucleotide
cguuccagcggccgucgucuu

SEQ ID NO: 1707 - RNA, 21 nt, Artificial Sequence
  Synthetic polynucleotide
ucguuccagcggccgucguuu

SEQ ID NO: 1708 - RNA, 21 nt, Artificial Sequence
  Synthetic polynucleotide
gucguuccagcggccgucguu

SEQ ID NO: 1709 - RNA, 21 nt, Artificial Sequence
  Synthetic polynucleotide
cgucguuccagcggccgucuu

SEQ ID NO: 1710 - RNA, 21 nt, Artificial Sequence
  Synthetic polynucleotide
guggaaauggauuggaacuuu

SEQ ID NO: 1711 - RNA, 21 nt, Artificial Sequence
  Synthetic polynucleotide
ucgucguuccagcggccguuu

SEQ ID NO: 1712 - RNA, 21 nt, Artificial Sequence
  Synthetic polynucleotide
gucgucguuccagcggccguu

SEQ ID NO: 1713 - RNA, 21 nt, Artificial Sequence
  Synthetic polynucleotide
cgucgucguuccagcggccuu

SEQ ID NO: 1714 - RNA, 21 nt, Artificial Sequence
  Synthetic polynucleotide
acgucgucguuccagcggcuu

SEQ ID NO: 1715 - RNA, 21 nt, Artificial Sequence
  Synthetic polynucleotide
gacgucgucguuccagcgguu

SEQ ID NO: 1716 - RNA, 21 nt, Artificial Sequence
  Synthetic polynucleotide
agacgucgucguuccagcguu

SEQ ID NO: 1717 - RNA, 21 nt, Artificial Sequence
  Synthetic polynucleotide
cagacgucgucguuccagcuu

SEQ ID NO: 1718 - RNA, 21 nt, Artificial Sequence
  Synthetic polynucleotide
gcagacgucgucguuccaguu

SEQ ID NO: 1719 - RNA, 21 nt, Artificial Sequence
  Synthetic polynucleotide
cuuccgugcaccguuuggguu

SEQ ID NO: 1720 - RNA, 21 nt, Artificial Sequence
  Synthetic polynucleotide
ggcagacgucgucguuccauu

SEQ ID NO: 1721 - RNA, 21 nt, Artificial Sequence
  Synthetic polynucleotide
uggcagacgucgucguuccuu

SEQ ID NO: 1722 - RNA, 21 nt, Artificial Sequence
  Synthetic polynucleotide
gguggaaauggauuggaacuu

SEQ ID NO: 1723 - RNA, 21 nt, Artificial Sequence
  Synthetic polynucleotide
cuggcagacgucgucguucuu

SEQ ID NO: 1724 - RNA, 21 nt, Artificial Sequence
  Synthetic polynucleotide
ucuggcagacgucgucguuuu

SEQ ID NO: 1725 - RNA, 21 nt, Artificial Sequence
  Synthetic polynucleotide
cucuggcagacgucgucguuu

SEQ ID NO: 1726 - RNA, 21 nt, Artificial Sequence
  Synthetic polynucleotide
ccucuggcagacgucgucguu

SEQ ID NO: 1727 - RNA, 21 nt, Artificial Sequence
  Synthetic polynucleotide
gccucuggcagacgucgucuu

SEQ ID NO: 1728 - RNA, 21 nt, Artificial Sequence
  Synthetic polynucleotide
ggccucuggcagacgucguuu

SEQ ID NO: 1729 - RNA, 21 nt, Artificial Sequence
  Synthetic polynucleotide
gggccucuggcagacgucguu

SEQ ID NO: 1730 - RNA, 21 nt, Artificial Sequence
  Synthetic polynucleotide
agggccucuggcagacgucuu

SEQ ID NO: 1731 - RNA, 21 nt, Artificial Sequence
  Synthetic polynucleotide
uagggccucuggcagacguuu

SEQ ID NO: 1732 - RNA, 21 nt, Artificial Sequence
  Synthetic polynucleotide
guagggccucuggcagacguu

SEQ ID NO: 1733 - RNA, 21 nt, Artificial Sequence
  Synthetic polynucleotide
agguggaaauggauuggaauu

SEQ ID NO: 1734 - RNA, 21 nt, Artificial Sequence
  Synthetic polynucleotide
gguagggccucuggcagacuu

SEQ ID NO: 1735 - RNA, 21 nt, Artificial Sequence
  Synthetic polynucleotide
cgguagggccucuggcagauu

SEQ ID NO: 1736 - RNA, 21 nt, Artificial Sequence
  Synthetic polynucleotide
gcgguagggccucuggcaguu

SEQ ID NO: 1737 - RNA, 21 nt, Artificial Sequence
  Synthetic polynucleotide
agcgguagggccucuggcauu

SEQ ID NO: 1738 - RNA, 21 nt, Artificial Sequence
  Synthetic polynucleotide
cagcgguagggccucuggcuu

SEQ ID NO: 1739 - RNA, 21 nt, Artificial Sequence
  Synthetic polynucleotide
ccagcgguagggccucugguu

SEQ ID NO: 1740 - RNA, 21 nt, Artificial Sequence
  Synthetic polynucleotide
cccagcgguagggccucuguu

SEQ ID NO: 1741 - RNA, 21 nt, Artificial Sequence
  Synthetic polynucleotide
acccagcgguagggccucuuu

SEQ ID NO: 1742 - RNA, 21 nt, Artificial Sequence
  Synthetic polynucleotide
gacccagcgguagggccucuu

SEQ ID NO: 1743 - RNA, 21 nt, Artificial Sequence
  Synthetic polynucleotide
agacccagcgguagggccuuu

SEQ ID NO: 1744 - RNA, 21 nt, Artificial Sequence
  Synthetic polynucleotide
gagguggaaauggauuggauu

SEQ ID NO: 1745 - RNA, 21 nt, Artificial Sequence
  Synthetic polynucleotide
cagacccagcgguagggccuu

SEQ ID NO: 1746 - RNA, 21 nt, Artificial Sequence
  Synthetic polynucleotide
gcagacccagcgguagggcuu

SEQ ID NO: 1747 - RNA, 21 nt, Artificial Sequence
  Synthetic polynucleotide
cgcagacccagcgguaggguu

SEQ ID NO: 1748 - RNA, 21 nt, Artificial Sequence
  Synthetic polynucleotide
ucgcagacccagcgguagguu

SEQ ID NO: 1749 - RNA, 21 nt, Artificial Sequence
  Synthetic polynucleotide
cucgcagacccagcgguaguu

SEQ ID NO: 1750 - RNA, 21 nt, Artificial Sequence
  Synthetic polynucleotide
ucucgcagacccagcgguauu

SEQ ID NO: 1751 - RNA, 21 nt, Artificial Sequence
  Synthetic polynucleotide
gucucgcagacccagcgguuu

SEQ ID NO: 1752 - RNA, 21 nt, Artificial Sequence
  Synthetic polynucleotide
ugucucgcagacccagcgguu

SEQ ID NO: 1753 - RNA, 21 nt, Artificial Sequence
  Synthetic polynucleotide
cugucucgcagacccagcguu

SEQ ID NO: 1754 - RNA, 21 nt, Artificial Sequence
  Synthetic polynucleotide
ucugucucgcagacccagcuu

SEQ ID NO: 1755 - RNA, 21 nt, Artificial Sequence
  Synthetic polynucleotide
agagguggaaauggauugguu

SEQ ID NO: 1756 - RNA, 21 nt, Artificial Sequence
  Synthetic polynucleotide
cucugucucgcagacccaguu

SEQ ID NO: 1757 - RNA, 21 nt, Artificial Sequence
  Synthetic polynucleotide
gcucugucucgcagacccauu

SEQ ID NO: 1758 - RNA, 21 nt, Artificial Sequence
  Synthetic polynucleotide
agcucugucucgcagacccuu

SEQ ID NO: 1759 - RNA, 21 nt, Artificial Sequence
  Synthetic polynucleotide
cagcucugucucgcagaccuu

SEQ ID NO: 1760 - RNA, 21 nt, Artificial Sequence
  Synthetic polynucleotide
ccagcucugucucgcagacuu

SEQ ID NO: 1761 - RNA, 21 nt, Artificial Sequence
  Synthetic polynucleotide
uccagcucugucucgcagauu

SEQ ID NO: 1762 - RNA, 21 nt, Artificial Sequence
  Synthetic polynucleotide
guccagcucugucucgcaguu

SEQ ID NO: 1763 - RNA, 21 nt, Artificial Sequence
  Synthetic polynucleotide
uguccagcucugucucgcauu

SEQ ID NO: 1764 - RNA, 21 nt, Artificial Sequence
  Synthetic polynucleotide
gucaccucacucuuccguguu

SEQ ID NO: 1765 - RNA, 21 nt, Artificial Sequence
  Synthetic polynucleotide
uuguccagcucugucucgcuu

SEQ ID NO: 1766 - RNA, 21 nt, Artificial Sequence
  Synthetic polynucleotide
cuuguccagcucugucucguu

SEQ ID NO: 1767 - RNA, 21 nt, Artificial Sequence
  Synthetic polynucleotide
cagagguggaaauggauuguu

SEQ ID NO: 1768 - RNA, 21 nt, Artificial Sequence
  Synthetic polynucleotide
ccuuguccagcucugucucuu

SEQ ID NO: 1769 - RNA, 21 nt, Artificial Sequence
  Synthetic polynucleotide
gccuuguccagcucugucuuu

SEQ ID NO: 1770 - RNA, 21 nt, Artificial Sequence
  Synthetic polynucleotide
ggccuuguccagcucugucuu

SEQ ID NO: 1771 - RNA, 21 nt, Artificial Sequence
  Synthetic polynucleotide
uggccuuguccagcucuguuu

SEQ ID NO: 1772 - RNA, 21 nt, Artificial Sequence
  Synthetic polynucleotide
cuggccuuguccagcucuguu

SEQ ID NO: 1773 - RNA, 21 nt, Artificial Sequence
  Synthetic polynucleotide
gcuggccuuguccagcucuuu

SEQ ID NO: 1774 - RNA, 21 nt, Artificial Sequence
  Synthetic polynucleotide
ggcuggccuuguccagcucuu

SEQ ID NO: 1775 - RNA, 21 nt, Artificial Sequence
  Synthetic polynucleotide
uggcuggccuuguccagcuuu

SEQ ID NO: 1776 - RNA, 21 nt, Artificial Sequence
  Synthetic polynucleotide
cuggcuggccuuguccagcuu

SEQ ID NO: 1777 - RNA, 21 nt, Artificial Sequence
  Synthetic polynucleotide
ccuggcuggccuuguccaguu

SEQ ID NO: 1778 - RNA, 21 nt, Artificial Sequence
  Synthetic polynucleotide
acagagguggaaauggauuuu

SEQ ID NO: 1779 - RNA, 21 nt, Artificial Sequence
  Synthetic polynucleotide
uccuggcuggccuuguccauu

SEQ ID NO: 1780 - RNA, 21 nt, Artificial Sequence
  Synthetic polynucleotide
cuccuggcuggccuuguccuu

SEQ ID NO: 1781 - RNA, 21 nt, Artificial Sequence
  Synthetic polynucleotide
gcuccuggcuggccuugucuu

SEQ ID NO: 1782 - RNA, 21 nt, Artificial Sequence
  Synthetic polynucleotide
ggcuccuggcuggccuuguuu

SEQ ID NO: 1783 - RNA, 21 nt, Artificial Sequence
  Synthetic polynucleotide
uggcuccuggcuggccuuguu

SEQ ID NO: 1784 - RNA, 21 nt, Artificial Sequence
  Synthetic polynucleotide
guggcuccuggcuggccuuuu

SEQ ID NO: 1785 - RNA, 21 nt, Artificial Sequence
  Synthetic polynucleotide
gguggcuccuggcuggccuuu

SEQ ID NO: 1786 - RNA, 21 nt, Artificial Sequence
  Synthetic polynucleotide
agguggcuccuggcuggccuu

SEQ ID NO: 1787 - RNA, 21 nt, Artificial Sequence
  Synthetic polynucleotide
gagguggcuccuggcuggcuu

SEQ ID NO: 1788 - RNA, 21 nt, Artificial Sequence
  Synthetic polynucleotide
agagguggcuccuggcugguu

SEQ ID NO: 1789 - RNA, 21 nt, Artificial Sequence
  Synthetic polynucleotide
aacagagguggaaauggauuu

SEQ ID NO: 1790 - RNA, 21 nt, Artificial Sequence
  Synthetic polynucleotide
gagagguggcuccuggcuguu

SEQ ID NO: 1791 - RNA, 21 nt, Artificial Sequence
  Synthetic polynucleotide
ggagagguggcuccuggcuuu

SEQ ID NO: 1792 - RNA, 21 nt, Artificial Sequence
  Synthetic polynucleotide
aggagagguggcuccuggcuu

SEQ ID NO: 1793 - RNA, 21 nt, Artificial Sequence
  Synthetic polynucleotide
aaggagagguggcuccugguu

SEQ ID NO: 1794 - RNA, 21 nt, Artificial Sequence
  Synthetic polynucleotide
aaaggagagguggcuccuguu

SEQ ID NO: 1795 - RNA, 21 nt, Artificial Sequence
  Synthetic polynucleotide
uaaaggagagguggcuccuuu

SEQ ID NO: 1796 - RNA, 21 nt, Artificial Sequence
  Synthetic polynucleotide
uuaaaggagagguggcuccuu

SEQ ID NO: 1797 - RNA, 21 nt, Artificial Sequence
  Synthetic polynucleotide
auuaaaggagagguggcucuu

SEQ ID NO: 1798 - RNA, 21 nt, Artificial Sequence
  Synthetic polynucleotide
aauuaaaggagagguggcuuu

SEQ ID NO: 1799 - RNA, 21 nt, Artificial Sequence
  Synthetic polynucleotide
aaauuaaaggagagguggcuu

SEQ ID NO: 1800 - RNA, 21 nt, Artificial Sequence
  Synthetic polynucleotide
aaacagagguggaaauggauu

SEQ ID NO: 1801 - RNA, 21 nt, Artificial Sequence
  Synthetic polynucleotide
uaaauuaaaggagaggugguu

SEQ ID NO: 1802 - RNA, 21 nt, Artificial Sequence
  Synthetic polynucleotide
auaaauuaaaggagagguguu

SEQ ID NO: 1803 - RNA, 21 nt, Artificial Sequence
  Synthetic polynucleotide
aauaaauuaaaggagagguuu

SEQ ID NO: 1804 - RNA, 21 nt, Artificial Sequence
  Synthetic polynucleotide
aaauaaauuaaaggagagguu

SEQ ID NO: 1805 - RNA, 21 nt, Artificial Sequence
  Synthetic polynucleotide
gaaauaaauuaaaggagaguu

SEQ ID NO: 1806 - RNA, 21 nt, Artificial Sequence
  Synthetic polynucleotide
agaaauaaauuaaaggagauu

SEQ ID NO: 1807 - RNA, 21 nt, Artificial Sequence
  Synthetic polynucleotide
aagaaauaaauuaaaggaguu

SEQ ID NO: 1808 - RNA, 21 nt, Artificial Sequence
  Synthetic polynucleotide
gaagaaauaaauuaaaggauu

SEQ ID NO: 1809 - RNA, 21 nt, Artificial Sequence
  Synthetic polynucleotide
ugaagaaauaaauuaaagguu

SEQ ID NO: 1810 - RNA, 21 nt, Artificial Sequence
  Synthetic polynucleotide
uugaagaaauaaauuaaaguu

SEQ ID NO: 1811 - RNA, 21 nt, Artificial Sequence
  Synthetic polynucleotide
uaaacagagguggaaaugguu

SEQ ID NO: 1812 - RNA, 21 nt, Artificial Sequence
  Synthetic polynucleotide
auugaagaaauaaauuaaauu

SEQ ID NO: 1813 - RNA, 21 nt, Artificial Sequence
  Synthetic polynucleotide
cauugaagaaauaaauuaauu

SEQ ID NO: 1814 - RNA, 21 nt, Artificial Sequence
  Synthetic polynucleotide
gcauugaagaaauaaauuauu

SEQ ID NO: 1815 - RNA, 21 nt, Artificial Sequence
  Synthetic polynucleotide
ggcauugaagaaauaaauuuu

SEQ ID NO: 1816 - RNA, 21 nt, Artificial Sequence
  Synthetic polynucleotide
aggcauugaagaaauaaauuu

SEQ ID NO: 1817 - RNA, 21 nt, Artificial Sequence
  Synthetic polynucleotide
gaggcauugaagaaauaaauu

SEQ ID NO: 1818 - RNA, 21 nt, Artificial Sequence
  Synthetic polynucleotide
cgaggcauugaagaaauaauu

SEQ ID NO: 1819 - RNA, 21 nt, Artificial Sequence
  Synthetic polynucleotide
ucgaggcauugaagaaauauu

SEQ ID NO: 1820 - RNA, 21 nt, Artificial Sequence
  Synthetic polynucleotide
gucgaggcauugaagaaauuu

SEQ ID NO: 1821 - RNA, 21 nt, Artificial Sequence
  Synthetic polynucleotide
ggucgaggcauugaagaaauu

SEQ ID NO: 1822 - RNA, 21 nt, Artificial Sequence
  Synthetic polynucleotide
guaaacagagguggaaauguu

SEQ ID NO: 1823 - RNA, 21 nt, Artificial Sequence
  Synthetic polynucleotide
aggucgaggcauugaagaauu

SEQ ID NO: 1824 - RNA, 21 nt, Artificial Sequence
  Synthetic polynucleotide
caggucgaggcauugaagauu

SEQ ID NO: 1825 - RNA, 21 nt, Artificial Sequence
  Synthetic polynucleotide
gcaggucgaggcauugaaguu

SEQ ID NO: 1826 - RNA, 21 nt, Artificial Sequence
  Synthetic polynucleotide
ggcaggucgaggcauugaauu

SEQ ID NO: 1827 - RNA, 21 nt, Artificial Sequence
  Synthetic polynucleotide
cggcaggucgaggcauugauu

SEQ ID NO: 1828 - RNA, 21 nt, Artificial Sequence
  Synthetic polynucleotide
gcggcaggucgaggcauuguu

SEQ ID NO: 1829 - RNA, 21 nt, Artificial Sequence
  Synthetic polynucleotide
ugcggcaggucgaggcauuuu

SEQ ID NO: 1830 - RNA, 21 nt, Artificial Sequence
  Synthetic polynucleotide
cugcggcaggucgaggcauuu

SEQ ID NO: 1831 - RNA, 21 nt, Artificial Sequence
  Synthetic polynucleotide
ccugcggcaggucgaggcauu

SEQ ID NO: 1832 - RNA, 21 nt, Artificial Sequence
  Synthetic polynucleotide
cccugcggcaggucgaggcuu

SEQ ID NO: 1833 - RNA, 21 nt, Artificial Sequence
  Synthetic polynucleotide
aguaaacagagguggaaauuu

SEQ ID NO: 1834 - RNA, 21 nt, Artificial Sequence
  Synthetic polynucleotide
ccccugcggcaggucgagguu

SEQ ID NO: 1835 - RNA, 21 nt, Artificial Sequence
  Synthetic polynucleotide
accccugcggcaggucgaguu

SEQ ID NO: 1836 - RNA, 21 nt, Artificial Sequence
  Synthetic polynucleotide
gaccccugcggcaggucgauu

SEQ ID NO: 1837 - RNA, 21 nt, Artificial Sequence
  Synthetic polynucleotide
ggaccccugcggcaggucguu

SEQ ID NO: 1838 - RNA, 21 nt, Artificial Sequence
  Synthetic polynucleotide
cggaccccugcggcaggucuu

SEQ ID NO: 1839 - RNA, 21 nt, Artificial Sequence
  Synthetic polynucleotide
ccggaccccugcggcagguuu

SEQ ID NO: 1840 - RNA, 21 nt, Artificial Sequence
  Synthetic polynucleotide
cccggaccccugcggcagguu

SEQ ID NO: 1841 - RNA, 21 nt, Artificial Sequence
  Synthetic polynucleotide
ucccggaccccugcggcaguu

SEQ ID NO: 1842 - RNA, 21 nt, Artificial Sequence
  Synthetic polynucleotide
aucccggaccccugcggcauu

SEQ ID NO: 1843 - RNA, 21 nt, Artificial Sequence
  Synthetic polynucleotide
aaucccggaccccugcggcuu

SEQ ID NO: 1844 - RNA, 21 nt, Artificial Sequence
  Synthetic polynucleotide
caguaaacagagguggaaauu

SEQ ID NO: 1845 - RNA, 21 nt, Artificial Sequence
  Synthetic polynucleotide
caaucccggaccccugcgguu

SEQ ID NO: 1846 - RNA, 21 nt, Artificial Sequence
  Synthetic polynucleotide
ccaaucccggaccccugcguu

SEQ ID NO: 1847 - RNA, 21 nt, Artificial Sequence
  Synthetic polynucleotide
cccaaucccggaccccugcuu

SEQ ID NO: 1848 - RNA, 21 nt, Artificial Sequence
  Synthetic polynucleotide
ucccaaucccggaccccuguu

SEQ ID NO: 1849 - RNA, 21 nt, Artificial Sequence
  Synthetic polynucleotide
uucccaaucccggaccccuuu

SEQ ID NO: 1850 - RNA, 21 nt, Artificial Sequence
  Synthetic polynucleotide
auucccaaucccggaccccuu

SEQ ID NO: 1851 - RNA, 21 nt, Artificial Sequence
  Synthetic polynucleotide
gauucccaaucccggacccuu

SEQ ID NO: 1852 - RNA, 21 nt, Artificial Sequence
  Synthetic polynucleotide
ggauucccaaucccggaccuu

SEQ ID NO: 1853 - RNA, 21 nt, Artificial Sequence
  Synthetic polynucleotide
cggauucccaaucccggacuu

SEQ ID NO: 1854 - RNA, 21 nt, Artificial Sequence
  Synthetic polynucleotide
gcggauucccaaucccggauu

SEQ ID NO: 1855 - RNA, 21 nt, Artificial Sequence
  Synthetic polynucleotide
acaguaaacagagguggaauu

SEQ ID NO: 1856 - RNA, 21 nt, Artificial Sequence
  Synthetic polynucleotide
ggcggauucccaaucccgguu

SEQ ID NO: 1857 - RNA, 21 nt, Artificial Sequence
  Synthetic polynucleotide
gggcggauucccaaucccguu

SEQ ID NO: 1858 - RNA, 21 nt, Artificial Sequence
  Synthetic polynucleotide
ugggcggauucccaaucccuu

SEQ ID NO: 1859 - RNA, 21 nt, Artificial Sequence
  Synthetic polynucleotide
augggcggauucccaauccuu

SEQ ID NO: 1860 - RNA, 21 nt, Artificial Sequence
  Synthetic polynucleotide
gaugggcggauucccaaucuu

SEQ ID NO: 1861 - RNA, 21 nt, Artificial Sequence
  Synthetic polynucleotide
agaugggcggauucccaauuu

SEQ ID NO: 1862 - RNA, 21 nt, Artificial Sequence
  Synthetic polynucleotide
cagaugggcggauucccaauu

SEQ ID NO: 1863 - RNA, 21 nt, Artificial Sequence
  Synthetic polynucleotide
ccagaugggcggauucccauu

SEQ ID NO: 1864 - RNA, 21 nt, Artificial Sequence
  Synthetic polynucleotide
cccagaugggcggauucccuu

SEQ ID NO: 1865 - RNA, 21 nt, Artificial Sequence
  Synthetic polynucleotide
ccccagaugggcggauuccuu

SEQ ID NO: 1866 - RNA, 21 nt, Artificial Sequence
  Synthetic polynucleotide
gacaguaaacagagguggauu

SEQ ID NO: 1867 - RNA, 21 nt, Artificial Sequence
  Synthetic polynucleotide
cccccagaugggcggauucuu

SEQ ID NO: 1868 - RNA, 21 nt, Artificial Sequence
  Synthetic polynucleotide
gcccccagaugggcggauuuu

SEQ ID NO: 1869 - RNA, 21 nt, Artificial Sequence
  Synthetic polynucleotide
ggcccccagaugggcggauuu

SEQ ID NO: 1870 - RNA, 21 nt, Artificial Sequence
  Synthetic polynucleotide
aggcccccagaugggcggauu

SEQ ID NO: 1871 - RNA, 21 nt, Artificial Sequence
  Synthetic polynucleotide
gaggcccccagaugggcgguu

SEQ ID NO: 1872 - RNA, 21 nt, Artificial Sequence
  Synthetic polynucleotide
agaggcccccagaugggcguu

SEQ ID NO: 1873 - RNA, 21 nt, Artificial Sequence
  Synthetic polynucleotide
aagaggcccccagaugggcuu

SEQ ID NO: 1874 - RNA, 21 nt, Artificial Sequence
  Synthetic polynucleotide
gaagaggcccccagauggguu

SEQ ID NO: 1875 - RNA, 21 nt, Artificial Sequence
  Synthetic polynucleotide
agaagaggcccccagaugguu

SEQ ID NO: 1876 - RNA, 21 nt, Artificial Sequence
  Synthetic polynucleotide
agucaccucacucuuccguuu

SEQ ID NO: 1877 - RNA, 21 nt, Artificial Sequence
  Synthetic polynucleotide
cagaagaggcccccagauguu

SEQ ID NO: 1878 - RNA, 21 nt, Artificial Sequence
  Synthetic polynucleotide
ggacaguaaacagaggugguu

SEQ ID NO: 1879 - RNA, 21 nt, Artificial Sequence
  Synthetic polynucleotide
gcagaagaggcccccagauuu

SEQ ID NO: 1880 - RNA, 21 nt, Artificial Sequence
  Synthetic polynucleotide
agcagaagaggcccccagauu

SEQ ID NO: 1881 - RNA, 21 nt, Artificial Sequence
  Synthetic polynucleotide
aagcagaagaggcccccaguu

SEQ ID NO: 1882 - RNA, 21 nt, Artificial Sequence
  Synthetic polynucleotide
aaagcagaagaggcccccauu

SEQ ID NO: 1883 - RNA, 21 nt, Artificial Sequence
  Synthetic polynucleotide
gaaagcagaagaggcccccuu

SEQ ID NO: 1884 - RNA, 21 nt, Artificial Sequence
  Synthetic polynucleotide
agaaagcagaagaggccccuu

SEQ ID NO: 1885 - RNA, 21 nt, Artificial Sequence
  Synthetic polynucleotide
gagaaagcagaagaggcccuu

SEQ ID NO: 1886 - RNA, 21 nt, Artificial Sequence
  Synthetic polynucleotide
cgagaaagcagaagaggccuu

SEQ ID NO: 1887 - RNA, 21 nt, Artificial Sequence
  Synthetic polynucleotide
ccgagaaagcagaagaggcuu

SEQ ID NO: 1888 - RNA, 21 nt, Artificial Sequence
  Synthetic polynucleotide
cccgagaaagcagaagagguu

SEQ ID NO: 1889 - RNA, 21 nt, Artificial Sequence
  Synthetic polynucleotide
uggacaguaaacagagguguu

SEQ ID NO: 1890 - RNA, 21 nt, Artificial Sequence
  Synthetic polynucleotide
ucccgagaaagcagaagaguu

SEQ ID NO: 1891 - RNA, 21 nt, Artificial Sequence
  Synthetic polynucleotide
uucccgagaaagcagaagauu

SEQ ID NO: 1892 - RNA, 21 nt, Artificial Sequence
  Synthetic polynucleotide
auucccgagaaagcagaaguu

SEQ ID NO: 1893 - RNA, 21 nt, Artificial Sequence
  Synthetic polynucleotide
aauucccgagaaagcagaauu

SEQ ID NO: 1894 - RNA, 21 nt, Artificial Sequence
  Synthetic polynucleotide
aaauucccgagaaagcagauu

SEQ ID NO: 1895 - RNA, 21 nt, Artificial Sequence
  Synthetic polynucleotide
aaaauucccgagaaagcaguu

SEQ ID NO: 1896 - RNA, 21 nt, Artificial Sequence
  Synthetic polynucleotide
gaaaauucccgagaaagcauu

SEQ ID NO: 1897 - RNA, 21 nt, Artificial Sequence
  Synthetic polynucleotide
ugaaaauucccgagaaagcuu

SEQ ID NO: 1898 - RNA, 21 nt, Artificial Sequence
  Synthetic polynucleotide
augaaaauucccgagaaaguu

SEQ ID NO: 1899 - RNA, 21 nt, Artificial Sequence
  Synthetic polynucleotide
gaugaaaauucccgagaaauu

SEQ ID NO: 1900 - RNA, 21 nt, Artificial Sequence
  Synthetic polynucleotide
uuggacaguaaacagagguuu

SEQ ID NO: 1901 - RNA, 21 nt, Artificial Sequence
  Synthetic polynucleotide
agaugaaaauucccgagaauu

SEQ ID NO: 1902 - RNA, 21 nt, Artificial Sequence
  Synthetic polynucleotide
uagaugaaaauucccgagauu

SEQ ID NO: 1903 - RNA, 21 nt, Artificial Sequence
  Synthetic polynucleotide
cuagaugaaaauucccgaguu

SEQ ID NO: 1904 - RNA, 21 nt, Artificial Sequence
  Synthetic polynucleotide
ccuagaugaaaauucccgauu

SEQ ID NO: 1905 - RNA, 21 nt, Artificial Sequence
  Synthetic polynucleotide
uccuagaugaaaauucccguu

SEQ ID NO: 1906 - RNA, 21 nt, Artificial Sequence
  Synthetic polynucleotide
auccuagaugaaaauucccuu

SEQ ID NO: 1907 - RNA, 21 nt, Artificial Sequence
  Synthetic polynucleotide
aauccuagaugaaaauuccuu

SEQ ID NO: 1908 - RNA, 21 nt, Artificial Sequence
  Synthetic polynucleotide
aaauccuagaugaaaauucuu

SEQ ID NO: 1909 - RNA, 21 nt, Artificial Sequence
  Synthetic polynucleotide
aaaauccuagaugaaaauuuu

SEQ ID NO: 1910 - RNA, 21 nt, Artificial Sequence
  Synthetic polynucleotide
uaaaauccuagaugaaaauuu

SEQ ID NO: 1911 - RNA, 21 nt, Artificial Sequence
  Synthetic polynucleotide
uuuggacaguaaacagagguu

SEQ ID NO: 1912 - RNA, 21 nt, Artificial Sequence
  Synthetic polynucleotide
uuaaaauccuagaugaaaauu

SEQ ID NO: 1913 - RNA, 21 nt, Artificial Sequence
  Synthetic polynucleotide
cuuaaaauccuagaugaaauu

SEQ ID NO: 1914 - RNA, 21 nt, Artificial Sequence
  Synthetic polynucleotide
ccuuaaaauccuagaugaauu

SEQ ID NO: 1915 - RNA, 21 nt, Artificial Sequence
  Synthetic polynucleotide
cccuuaaaauccuagaugauu

SEQ ID NO: 1916 - RNA, 21 nt, Artificial Sequence
  Synthetic polynucleotide
ucccuuaaaauccuagauguu

SEQ ID NO: 1917 - RNA, 21 nt, Artificial Sequence
  Synthetic polynucleotide
uucccuuaaaauccuagauuu

SEQ ID NO: 1918 - RNA, 21 nt, Artificial Sequence
  Synthetic polynucleotide
cuucccuuaaaauccuagauu

SEQ ID NO: 1919 - RNA, 21 nt, Artificial Sequence
  Synthetic polynucleotide
ccuucccuuaaaauccuaguu

SEQ ID NO: 1920 - RNA, 21 nt, Artificial Sequence
  Synthetic polynucleotide
cccuucccuuaaaauccuauu

SEQ ID NO: 1921 - RNA, 21 nt, Artificial Sequence
  Synthetic polynucleotide
ccccuucccuuaaaauccuuu

SEQ ID NO: 1922 - RNA, 21 nt, Artificial Sequence
  Synthetic polynucleotide
cuuuggacaguaaacagaguu

SEQ ID NO: 1923 - RNA, 21 nt, Artificial Sequence
  Synthetic polynucleotide
uccccuucccuuaaaauccuu

SEQ ID NO: 1924 - RNA, 21 nt, Artificial Sequence
  Synthetic polynucleotide
uuccccuucccuuaaaaucuu

SEQ ID NO: 1925 - RNA, 21 nt, Artificial Sequence
  Synthetic polynucleotide
cuuccccuucccuuaaaauuu

SEQ ID NO: 1926 - RNA, 21 nt, Artificial Sequence
  Synthetic polynucleotide
ccuuccccuucccuuaaaauu

SEQ ID NO: 1927 - RNA, 21 nt, Artificial Sequence
  Synthetic polynucleotide
uccuuccccuucccuuaaauu

SEQ ID NO: 1928 - RNA, 21 nt, Artificial Sequence
  Synthetic polynucleotide
auccuuccccuucccuuaauu

SEQ ID NO: 1929 - RNA, 21 nt, Artificial Sequence
  Synthetic polynucleotide
uauccuuccccuucccuuauu

SEQ ID NO: 1930 - RNA, 21 nt, Artificial Sequence
  Synthetic polynucleotide
cuauccuuccccuucccuuuu

SEQ ID NO: 1931 - RNA, 21 nt, Artificial Sequence
  Synthetic polynucleotide
ccuauccuuccccuucccuuu

SEQ ID NO: 1932 - RNA, 21 nt, Artificial Sequence
  Synthetic polynucleotide
cccuauccuuccccuucccuu

SEQ ID NO: 1933 - RNA, 21 nt, Artificial Sequence
  Synthetic polynucleotide
acuuuggacaguaaacagauu

SEQ ID NO: 1934 - RNA, 21 nt, Artificial Sequence
  Synthetic polynucleotide
acccuauccuuccccuuccuu

SEQ ID NO: 1935 - RNA, 21 nt, Artificial Sequence
  Synthetic polynucleotide
cacccuauccuuccccuucuu

SEQ ID NO: 1936 - RNA, 21 nt, Artificial Sequence
  Synthetic polynucleotide
ucacccuauccuuccccuuuu

SEQ ID NO: 1937 - RNA, 21 nt, Artificial Sequence
  Synthetic polynucleotide
aucacccuauccuuccccuuu

SEQ ID NO: 1938 - RNA, 21 nt, Artificial Sequence
  Synthetic polynucleotide
caucacccuauccuuccccuu

SEQ ID NO: 1939 - RNA, 21 nt, Artificial Sequence
  Synthetic polynucleotide
acaucacccuauccuucccuu

SEQ ID NO: 1940 - RNA, 21 nt, Artificial Sequence
  Synthetic polynucleotide
aacaucacccuauccuuccuu

SEQ ID NO: 1941 - RNA, 21 nt, Artificial Sequence
  Synthetic polynucleotide
gaacaucacccuauccuucuu

SEQ ID NO: 1942 - RNA, 21 nt, Artificial Sequence
  Synthetic polynucleotide
ggaacaucacccuauccuuuu

SEQ ID NO: 1943 - RNA, 21 nt, Artificial Sequence
  Synthetic polynucleotide
cggaacaucacccuauccuuu

SEQ ID NO: 1944 - RNA, 21 nt, Artificial Sequence
  Synthetic polynucleotide
gacuuuggacaguaaacaguu

SEQ ID NO: 1945 - RNA, 21 nt, Artificial Sequence
  Synthetic polynucleotide
ucggaacaucacccuauccuu

SEQ ID NO: 1946 - RNA, 21 nt, Artificial Sequence
  Synthetic polynucleotide
uucggaacaucacccuaucuu

SEQ ID NO: 1947 - RNA, 21 nt, Artificial Sequence
  Synthetic polynucleotide
cuucggaacaucacccuauuu

SEQ ID NO: 1948 - RNA, 21 nt, Artificial Sequence
  Synthetic polynucleotide
ccuucggaacaucacccuauu

SEQ ID NO: 1949 - RNA, 21 nt, Artificial Sequence
  Synthetic polynucleotide
accuucggaacaucacccuuu

SEQ ID NO: 1950 - RNA, 21 nt, Artificial Sequence
  Synthetic polynucleotide
caccuucggaacaucacccuu

SEQ ID NO: 1951 - RNA, 21 nt, Artificial Sequence
  Synthetic polynucleotide
ucaccuucggaacaucaccuu

SEQ ID NO: 1952 - RNA, 21 nt, Artificial Sequence
  Synthetic polynucleotide
cucaccuucggaacaucacuu

SEQ ID NO: 1953 - RNA, 21 nt, Artificial Sequence
  Synthetic polynucleotide
ccucaccuucggaacaucauu

SEQ ID NO: 1954 - RNA, 21 nt, Artificial Sequence
  Synthetic polynucleotide
uccucaccuucggaacaucuu

SEQ ID NO: 1955 - RNA, 21 nt, Artificial Sequence
  Synthetic polynucleotide
ggacuuuggacaguaaacauu

SEQ ID NO: 1956 - RNA, 21 nt, Artificial Sequence
  Synthetic polynucleotide
cuccucaccuucggaacauuu

SEQ ID NO: 1957 - RNA, 21 nt, Artificial Sequence
  Synthetic polynucleotide
gcuccucaccuucggaacauu

SEQ ID NO: 1958 - RNA, 21 nt, Artificial Sequence
  Synthetic polynucleotide
agcuccucaccuucggaacuu

SEQ ID NO: 1959 - RNA, 21 nt, Artificial Sequence
  Synthetic polynucleotide
aagcuccucaccuucggaauu

SEQ ID NO: 1960 - RNA, 21 nt, Artificial Sequence
  Synthetic polynucleotide
caagcuccucaccuucggauu

SEQ ID NO: 1961 - RNA, 21 nt, Artificial Sequence
  Synthetic polynucleotide
ucaagcuccucaccuucgguu

SEQ ID NO: 1962 - RNA, 21 nt, Artificial Sequence
  Synthetic polynucleotide
uucaagcuccucaccuucguu

SEQ ID NO: 1963 - RNA, 21 nt, Artificial Sequence
  Synthetic polynucleotide
uuucaagcuccucaccuucuu

SEQ ID NO: 1964 - RNA, 21 nt, Artificial Sequence
  Synthetic polynucleotide
guuucaagcuccucaccuuuu

SEQ ID NO: 1965 - RNA, 21 nt, Artificial Sequence
  Synthetic polynucleotide
gguuucaagcuccucaccuuu

SEQ ID NO: 1966 - RNA, 21 nt, Artificial Sequence
  Synthetic polynucleotide
gggacuuuggacaguaaacuu

SEQ ID NO: 1967 - RNA, 21 nt, Artificial Sequence
  Synthetic polynucleotide
ggguuucaagcuccucaccuu

SEQ ID NO: 1968 - RNA, 21 nt, Artificial Sequence
  Synthetic polynucleotide
cggguuucaagcuccucacuu

SEQ ID NO: 1969 - RNA, 21 nt, Artificial Sequence
  Synthetic polynucleotide
acggguuucaagcuccucauu

SEQ ID NO: 1970 - RNA, 21 nt, Artificial Sequence
  Synthetic polynucleotide
cacggguuucaagcuccucuu

SEQ ID NO: 1971 - RNA, 21 nt, Artificial Sequence
  Synthetic polynucleotide
ccacggguuucaagcuccuuu

SEQ ID NO: 1972 - RNA, 21 nt, Artificial Sequence
  Synthetic polynucleotide
gccacggguuucaagcuccuu

SEQ ID NO: 1973 - RNA, 21 nt, Artificial Sequence
  Synthetic polynucleotide
cgccacggguuucaagcucuu

SEQ ID NO: 1974 - RNA, 21 nt, Artificial Sequence
  Synthetic polynucleotide
gcgccacggguuucaagcuuu

SEQ ID NO: 1975 - RNA, 21 nt, Artificial Sequence
  Synthetic polynucleotide
agcgccacggguuucaagcuu

SEQ ID NO: 1976 - RNA, 21 nt, Artificial Sequence
  Synthetic polynucleotide
aagcgccacggguuucaaguu

SEQ ID NO: 1977 - RNA, 21 nt, Artificial Sequence
  Synthetic polynucleotide
cgggacuuuggacaguaaauu

SEQ ID NO: 1978 - RNA, 21 nt, Artificial Sequence
  Synthetic polynucleotide
aaagcgccacggguuucaauu

SEQ ID NO: 1979 - RNA, 21 nt, Artificial Sequence
  Synthetic polynucleotide
gaaagcgccacggguuucauu

SEQ ID NO: 1980 - RNA, 21 nt, Artificial Sequence
  Synthetic polynucleotide
agaaagcgccacggguuucuu

SEQ ID NO: 1981 - RNA, 21 nt, Artificial Sequence
  Synthetic polynucleotide
cagaaagcgccacggguuuuu

SEQ ID NO: 1982 - RNA, 21 nt, Artificial Sequence
  Synthetic polynucleotide
gcagaaagcgccacggguuuu

SEQ ID NO: 1983 - RNA, 21 nt, Artificial Sequence
  Synthetic polynucleotide
ugcagaaagcgccacggguuu

SEQ ID NO: 1984 - RNA, 21 nt, Artificial Sequence
  Synthetic polynucleotide
cugcagaaagcgccacggguu

SEQ ID NO: 1985 - RNA, 21 nt, Artificial Sequence
  Synthetic polynucleotide
acugcagaaagcgccacgguu

SEQ ID NO: 1986 - RNA, 21 nt, Artificial Sequence
  Synthetic polynucleotide
aacugcagaaagcgccacguu

SEQ ID NO: 1987 - RNA, 21 nt, Artificial Sequence
  Synthetic polynucleotide
aaacugcagaaagcgccacuu

SEQ ID NO: 1988 - RNA, 21 nt, Artificial Sequence
  Synthetic polynucleotide
ccgggacuuuggacaguaauu

SEQ ID NO: 1989 - RNA, 21 nt, Artificial Sequence
  Synthetic polynucleotide
cagucaccucacucuuccguu

SEQ ID NO: 1990 - RNA, 21 nt, Artificial Sequence
  Synthetic polynucleotide
caaacugcagaaagcgccauu

SEQ ID NO: 1991 - RNA, 21 nt, Artificial Sequence
  Synthetic polynucleotide
gcaaacugcagaaagcgccuu

SEQ ID NO: 1992 - RNA, 21 nt, Artificial Sequence
  Synthetic polynucleotide
ugcaaacugcagaaagcgcuu

SEQ ID NO: 1993 - RNA, 21 nt, Artificial Sequence
  Synthetic polynucleotide
cugcaaacugcagaaagcguu

SEQ ID NO: 1994 - RNA, 21 nt, Artificial Sequence
  Synthetic polynucleotide
ccugcaaacugcagaaagcuu

SEQ ID NO: 1995 - RNA, 21 nt, Artificial Sequence
  Synthetic polynucleotide
accugcaaacugcagaaaguu

SEQ ID NO: 1996 - RNA, 21 nt, Artificial Sequence
  Synthetic polynucleotide
aaccugcaaacugcagaaauu

SEQ ID NO: 1997 - RNA, 21 nt, Artificial Sequence
  Synthetic polynucleotide
uaaccugcaaacugcagaauu

SEQ ID NO: 1998 - RNA, 21 nt, Artificial Sequence
  Synthetic polynucleotide
auaaccugcaaacugcagauu

SEQ ID NO: 1999 - RNA, 21 nt, Artificial Sequence
  Synthetic polynucleotide
gauaaccugcaaacugcaguu

SEQ ID NO: 2000 - RNA, 21 nt, Artificial Sequence
  Synthetic polynucleotide
cccgggacuuuggacaguauu

SEQ ID NO: 2001 - RNA, 21 nt, Artificial Sequence
  Synthetic polynucleotide
ugauaaccugcaaacugcauu

SEQ ID NO: 2002 - RNA, 21 nt, Artificial Sequence
  Synthetic polynucleotide
augauaaccugcaaacugcuu

SEQ ID NO: 2003 - RNA, 21 nt, Artificial Sequence
  Synthetic polynucleotide
aaugauaaccugcaaacuguu

SEQ ID NO: 2004 - RNA, 21 nt, Artificial Sequence
  Synthetic polynucleotide
caaugauaaccugcaaacuuu

SEQ ID NO: 2005 - RNA, 21 nt, Artificial Sequence
  Synthetic polynucleotide
acaaugauaaccugcaaacuu

SEQ ID NO: 2006 - RNA, 21 nt, Artificial Sequence
  Synthetic polynucleotide
cacaaugauaaccugcaaauu

SEQ ID NO: 2007 - RNA, 21 nt, Artificial Sequence
  Synthetic polynucleotide
ucacaaugauaaccugcaauu

SEQ ID NO: 2008 - RNA, 21 nt, Artificial Sequence
  Synthetic polynucleotide
uucacaaugauaaccugcauu

SEQ ID NO: 2009 - RNA, 21 nt, Artificial Sequence
  Synthetic polynucleotide
guucacaaugauaaccugcuu

SEQ ID NO: 2010 - RNA, 21 nt, Artificial Sequence
  Synthetic polynucleotide
aguucacaaugauaaccuguu

SEQ ID NO: 2011 - RNA, 21 nt, Artificial Sequence
  Synthetic polynucleotide
gcccgggacuuuggacaguuu

SEQ ID NO: 2012 - RNA, 21 nt, Artificial Sequence
  Synthetic polynucleotide
aaguucacaaugauaaccuuu

SEQ ID NO: 2013 - RNA, 21 nt, Artificial Sequence
  Synthetic polynucleotide
aaaguucacaaugauaaccuu

SEQ ID NO: 2014 - RNA, 21 nt, Artificial Sequence
  Synthetic polynucleotide
aaaaguucacaaugauaacuu

SEQ ID NO: 2015 - RNA, 21 nt, Artificial Sequence
  Synthetic polynucleotide
aaaaaguucacaaugauaauu

SEQ ID NO: 2016 - RNA, 21 nt, Artificial Sequence
  Synthetic polynucleotide
aaaaaaguucacaaugauauu

SEQ ID NO: 2017 - RNA, 21 nt, Artificial Sequence
  Synthetic polynucleotide
aaaaaaaguucacaaugauuu

SEQ ID NO: 2018 - RNA, 21 nt, Artificial Sequence
  Synthetic polynucleotide
aaaaaaaaguucacaaugauu

SEQ ID NO: 2019 - RNA, 21 nt, Artificial Sequence
  Synthetic polynucleotide
aaaaaaaaaguucacaauguu

SEQ ID NO: 2020 - RNA, 21 nt, Artificial Sequence
  Synthetic polynucleotide
aaaaaaaaaaguucacaauuu

SEQ ID NO: 2021 - RNA, 21 nt, Artificial Sequence
  Synthetic polynucleotide
aaaaaaaaaaaguucacaauu

SEQ ID NO: 2022 - RNA, 21 nt, Artificial Sequence
  Synthetic polynucleotide
ugcccgggacuuuggacaguu

SEQ ID NO: 2023 - RNA, 21 nt, Artificial Sequence
  Synthetic polynucleotide
uaaaaaaaaaaaguucacauu

SEQ ID NO: 2024 - RNA, 21 nt, Artificial Sequence
  Synthetic polynucleotide
uuaaaaaaaaaaaguucacuu

SEQ ID NO: 2025 - RNA, 21 nt, Artificial Sequence
  Synthetic polynucleotide
cuuaaaaaaaaaaaguucauu

SEQ ID NO: 2026 - RNA, 21 nt, Artificial Sequence
  Synthetic polynucleotide
ucuuaaaaaaaaaaaguucuu

SEQ ID NO: 2027 - RNA, 21 nt, Artificial Sequence
  Synthetic polynucleotide
cucuuaaaaaaaaaaaguuuu

SEQ ID NO: 2028 - RNA, 21 nt, Artificial Sequence
  Synthetic polynucleotide
acucuuaaaaaaaaaaaguuu

SEQ ID NO: 2029 - RNA, 21 nt, Artificial Sequence
  Synthetic polynucleotide
uacucuuaaaaaaaaaaaguu

SEQ ID NO: 2030 - RNA, 21 nt, Artificial Sequence
  Synthetic polynucleotide
uuacucuuaaaaaaaaaaauu

SEQ ID NO: 2031 - RNA, 21 nt, Artificial Sequence
  Synthetic polynucleotide
uuuacucuuaaaaaaaaaauu

SEQ ID NO: 2032 - RNA, 21 nt, Artificial Sequence
  Synthetic polynucleotide
uuuuacucuuaaaaaaaaauu

SEQ ID NO: 2033 - RNA, 21 nt, Artificial Sequence
  Synthetic polynucleotide
gugcccgggacuuuggacauu

SEQ ID NO: 2034 - RNA, 21 nt, Artificial Sequence
  Synthetic polynucleotide
uuuuuacucuuaaaaaaaauu

SEQ ID NO: 2035 - RNA, 21 nt, Artificial Sequence
  Synthetic polynucleotide
cuuuuuacucuuaaaaaaauu

SEQ ID NO: 2036 - RNA, 21 nt, Artificial Sequence
  Synthetic polynucleotide
ucuuuuuacucuuaaaaaauu

SEQ ID NO: 2037 - RNA, 21 nt, Artificial Sequence
  Synthetic polynucleotide
uucuuuuuacucuuaaaaauu

SEQ ID NO: 2038 - RNA, 21 nt, Artificial Sequence
  Synthetic polynucleotide
uuucuuuuuacucuuaaaauu

SEQ ID NO: 2039 - RNA, 21 nt, Artificial Sequence
  Synthetic polynucleotide
auuucuuuuuacucuuaaauu

SEQ ID NO: 2040 - RNA, 21 nt, Artificial Sequence
  Synthetic polynucleotide
uauuucuuuuuacucuuaauu

SEQ ID NO: 2041 - RNA, 21 nt, Artificial Sequence
  Synthetic polynucleotide
auauuucuuuuuacucuuauu

SEQ ID NO: 2042 - RNA, 21 nt, Artificial Sequence
  Synthetic polynucleotide
uauauuucuuuuuacucuuuu

SEQ ID NO: 2043 - RNA, 21 nt, Artificial Sequence
  Synthetic polynucleotide
guauauuucuuuuuacucuuu

SEQ ID NO: 2044 - RNA, 21 nt, Artificial Sequence
  Synthetic polynucleotide
agugcccgggacuuuggacuu

SEQ ID NO: 2045 - RNA, 21 nt, Artificial Sequence
  Synthetic polynucleotide
gguauauuucuuuuuacucuu

SEQ ID NO: 2046 - RNA, 21 nt, Artificial Sequence
  Synthetic polynucleotide
agguauauuucuuuuuacuuu

SEQ ID NO: 2047 - RNA, 21 nt, Artificial Sequence
  Synthetic polynucleotide
uagguauauuucuuuuuacuu

SEQ ID NO: 2048 - RNA, 21 nt, Artificial Sequence
  Synthetic polynucleotide
uuagguauauuucuuuuuauu

SEQ ID NO: 2049 - RNA, 21 nt, Artificial Sequence
  Synthetic polynucleotide
cagugcccgggacuuuggauu

SEQ ID NO: 2050 - RNA, 21 nt, Artificial Sequence
  Synthetic polynucleotide
ccagugcccgggacuuugguu

SEQ ID NO: 2051 - RNA, 21 nt, Artificial Sequence
  Synthetic polynucleotide
uccagugcccgggacuuuguu

SEQ ID NO: 2052 - RNA, 21 nt, Artificial Sequence
  Synthetic polynucleotide
cuccagugcccgggacuuuuu

SEQ ID NO: 2053 - RNA, 21 nt, Artificial Sequence
  Synthetic polynucleotide
ucuccagugcccgggacuuuu

SEQ ID NO: 2054 - RNA, 21 nt, Artificial Sequence
  Synthetic polynucleotide
ccagucaccucacucuuccuu

SEQ ID NO: 2055 - RNA, 21 nt, Artificial Sequence
  Synthetic polynucleotide
aucuccagugcccgggacuuu

SEQ ID NO: 2056 - RNA, 21 nt, Artificial Sequence
  Synthetic polynucleotide
caucuccagugcccgggacuu

SEQ ID NO: 2057 - RNA, 21 nt, Artificial Sequence
  Synthetic polynucleotide
gcaucuccagugcccgggauu

SEQ ID NO: 2058 - RNA, 21 nt, Artificial Sequence
  Synthetic polynucleotide
ggcaucuccagugcccggguu

SEQ ID NO: 2059 - RNA, 21 nt, Artificial Sequence
  Synthetic polynucleotide
uggcaucuccagugcccgguu

SEQ ID NO: 2060 - RNA, 21 nt, Artificial Sequence
  Synthetic polynucleotide
guggcaucuccagugcccguu

SEQ ID NO: 2061 - RNA, 21 nt, Artificial Sequence
  Synthetic polynucleotide
cguggcaucuccagugcccuu

SEQ ID NO: 2062 - RNA, 21 nt, Artificial Sequence
  Synthetic polynucleotide
acguggcaucuccagugccuu

SEQ ID NO: 2063 - RNA, 21 nt, Artificial Sequence
  Synthetic polynucleotide
aacguggcaucuccagugcuu

SEQ ID NO: 2064 - RNA, 21 nt, Artificial Sequence
  Synthetic polynucleotide
aaacguggcaucuccaguguu

SEQ ID NO: 2065 - RNA, 21 nt, Artificial Sequence
  Synthetic polynucleotide
gccagucaccucacucuucuu

SEQ ID NO: 2066 - RNA, 21 nt, Artificial Sequence
  Synthetic polynucleotide
caaacguggcaucuccaguuu

SEQ ID NO: 2067 - RNA, 21 nt, Artificial Sequence
  Synthetic polynucleotide
ccaaacguggcaucuccaguu

SEQ ID NO: 2068 - RNA, 21 nt, Artificial Sequence
  Synthetic polynucleotide
gccaaacguggcaucuccauu

SEQ ID NO: 2069 - RNA, 21 nt, Artificial Sequence
  Synthetic polynucleotide
cgccaaacguggcaucuccuu

SEQ ID NO: 2070 - RNA, 21 nt, Artificial Sequence
  Synthetic polynucleotide
acgccaaacguggcaucucuu

SEQ ID NO: 2071 - RNA, 21 nt, Artificial Sequence
  Synthetic polynucleotide
cacgccaaacguggcaucuuu

SEQ ID NO: 2072 - RNA, 21 nt, Artificial Sequence
  Synthetic polynucleotide
gcacgccaaacguggcaucuu

SEQ ID NO: 2073 - RNA, 21 nt, Artificial Sequence
  Synthetic polynucleotide
agcacgccaaacguggcauuu

SEQ ID NO: 2074 - RNA, 21 nt, Artificial Sequence
  Synthetic polynucleotide
aagcacgccaaacguggcauu

SEQ ID NO: 2075 - RNA, 21 nt, Artificial Sequence
  Synthetic polynucleotide
caagcacgccaaacguggcuu

SEQ ID NO: 2076 - RNA, 21 nt, Artificial Sequence
  Synthetic polynucleotide
ugccagucaccucacucuuuu

SEQ ID NO: 2077 - RNA, 21 nt, Artificial Sequence
  Synthetic polynucleotide
ccaagcacgccaaacgugguu

SEQ ID NO: 2078 - RNA, 21 nt, Artificial Sequence
  Synthetic polynucleotide
uccaagcacgccaaacguguu

SEQ ID NO: 2079 - RNA, 21 nt, Artificial Sequence
  Synthetic polynucleotide
guccaagcacgccaaacguuu

SEQ ID NO: 2080 - RNA, 21 nt, Artificial Sequence
  Synthetic polynucleotide
uguccaagcacgccaaacguu

SEQ ID NO: 2081 - RNA, 21 nt, Artificial Sequence
  Synthetic polynucleotide
guguccaagcacgccaaacuu

SEQ ID NO: 2082 - RNA, 21 nt, Artificial Sequence
  Synthetic polynucleotide
uguguccaagcacgccaaauu

SEQ ID NO: 2083 - RNA, 21 nt, Artificial Sequence
  Synthetic polynucleotide
guguguccaagcacgccaauu

SEQ ID NO: 2084 - RNA, 21 nt, Artificial Sequence
  Synthetic polynucleotide
uguguguccaagcacgccauu

SEQ ID NO: 2085 - RNA, 21 nt, Artificial Sequence
  Synthetic polynucleotide
cuguguguccaagcacgccuu

SEQ ID NO: 2086 - RNA, 21 nt, Artificial Sequence
  Synthetic polynucleotide
ucuguguguccaagcacgcuu

SEQ ID NO: 2087 - RNA, 21 nt, Artificial Sequence
  Synthetic polynucleotide
augccagucaccucacucuuu

SEQ ID NO: 2088 - RNA, 21 nt, Artificial Sequence
  Synthetic polynucleotide
gucuguguguccaagcacguu

SEQ ID NO: 2089 - RNA, 21 nt, Artificial Sequence
  Synthetic polynucleotide
ugucuguguguccaagcacuu

SEQ ID NO: 2090 - RNA, 21 nt, Artificial Sequence
  Synthetic polynucleotide
gugucuguguguccaagcauu

SEQ ID NO: 2091 - RNA, 21 nt, Artificial Sequence
  Synthetic polynucleotide
cgugucuguguguccaagcuu

SEQ ID NO: 2092 - RNA, 21 nt, Artificial Sequence
  Synthetic polynucleotide
gcgugucuguguguccaaguu

SEQ ID NO: 2093 - RNA, 21 nt, Artificial Sequence
  Synthetic polynucleotide
ugcgugucuguguguccaauu

SEQ ID NO: 2094 - RNA, 21 nt, Artificial Sequence
  Synthetic polynucleotide
cugcgugucuguguguccauu

SEQ ID NO: 2095 - RNA, 21 nt, Artificial Sequence
  Synthetic polynucleotide
ucugcgugucuguguguccuu

SEQ ID NO: 2096 - RNA, 21 nt, Artificial Sequence
  Synthetic polynucleotide
gucugcgugucugugugucuu

SEQ ID NO: 2097 - RNA, 21 nt, Artificial Sequence
  Synthetic polynucleotide
ugucugcgugucuguguguuu

SEQ ID NO: 2098 - RNA, 21 nt, Artificial Sequence
  Synthetic polynucleotide
caugccagucaccucacucuu

SEQ ID NO: 2099 - RNA, 21 nt, Artificial Sequence
  Synthetic polynucleotide
gugucugcgugucuguguguu

SEQ ID NO: 2100 - RNA, 21 nt, Artificial Sequence
  Synthetic polynucleotide
ugugucugcgugucuguguuu

SEQ ID NO: 2101 - RNA, 21 nt, Artificial Sequence
  Synthetic polynucleotide
cugugucugcgugucuguguu

SEQ ID NO: 2102 - RNA, 21 nt, Artificial Sequence
  Synthetic polynucleotide
ucugugucugcgugucuguuu

SEQ ID NO: 2103 - RNA, 21 nt, Artificial Sequence
  Synthetic polynucleotide
cucugugucugcgugucuguu

SEQ ID NO: 2104 - RNA, 21 nt, Artificial Sequence
  Synthetic polynucleotide
ucucugugucugcgugucuuu

SEQ ID NO: 2105 - RNA, 21 nt, Artificial Sequence
  Synthetic polynucleotide
gucucugugucugcgugucuu

SEQ ID NO: 2106 - RNA, 21 nt, Artificial Sequence
  Synthetic polynucleotide
ugucucugugucugcguguuu

SEQ ID NO: 2107 - RNA, 21 nt, Artificial Sequence
  Synthetic polynucleotide
gugucucugugucugcguguu

SEQ ID NO: 2108 - RNA, 21 nt, Artificial Sequence
  Synthetic polynucleotide
ggugucucugugucugcguuu

SEQ ID NO: 2109 - RNA, 21 nt, Artificial Sequence
  Synthetic polynucleotide
acaugccagucaccucacuuu

SEQ ID NO: 2110 - RNA, 21 nt, Artificial Sequence
  Synthetic polynucleotide
cggugucucugugucugcguu

SEQ ID NO: 2111 - RNA, 21 nt, Artificial Sequence
  Synthetic polynucleotide
ccggugucucugugucugcuu

SEQ ID NO: 2112 - RNA, 21 nt, Artificial Sequence
  Synthetic polynucleotide
cccggugucucugugucuguu

SEQ ID NO: 2113 - RNA, 21 nt, Artificial Sequence
  Synthetic polynucleotide
ccccggugucucugugucuuu

SEQ ID NO: 2114 - RNA, 21 nt, Artificial Sequence
  Synthetic polynucleotide
gccccggugucucugugucuu

SEQ ID NO: 2115 - RNA, 21 nt, Artificial Sequence
  Synthetic polynucleotide
ggccccggugucucuguguuu

SEQ ID NO: 2116 - RNA, 21 nt, Artificial Sequence
  Synthetic polynucleotide
gggccccggugucucuguguu

SEQ ID NO: 2117 - RNA, 21 nt, Artificial Sequence
  Synthetic polynucleotide
ugggccccggugucucuguuu

SEQ ID NO: 2118 - RNA, 21 nt, Artificial Sequence
  Synthetic polynucleotide
cugggccccggugucucuguu

SEQ ID NO: 2119 - RNA, 21 nt, Artificial Sequence
  Synthetic polynucleotide
ccugggccccggugucucuuu

SEQ ID NO: 2120 - RNA, 21 nt, Artificial Sequence
  Synthetic polynucleotide
cacaugccagucaccucacuu

SEQ ID NO: 2121 - RNA, 21 nt, Artificial Sequence
  Synthetic polynucleotide
cccugggccccggugucucuu

SEQ ID NO: 2122 - RNA, 21 nt, Artificial Sequence
  Synthetic polynucleotide
gcccugggccccggugucuuu

SEQ ID NO: 2123 - RNA, 21 nt, Artificial Sequence
  Synthetic polynucleotide
ggcccugggccccggugucuu

SEQ ID NO: 2124 - RNA, 21 nt, Artificial Sequence
  Synthetic polynucleotide
gggcccugggccccgguguuu

SEQ ID NO: 2125 - RNA, 21 nt, Artificial Sequence
  Synthetic polynucleotide
agggcccugggccccgguguu

SEQ ID NO: 2126 - RNA, 21 nt, Artificial Sequence
  Synthetic polynucleotide
gagggcccugggccccgguuu

SEQ ID NO: 2127 - RNA, 21 nt, Artificial Sequence
  Synthetic polynucleotide
ucuuccgugcaccguuugguu

SEQ ID NO: 2128 - RNA, 21 nt, Artificial Sequence
  Synthetic polynucleotide
ggagggcccugggccccgguu

SEQ ID NO: 2129 - RNA, 21 nt, Artificial Sequence
  Synthetic polynucleotide
aggagggcccugggccccguu

SEQ ID NO: 2130 - RNA, 21 nt, Artificial Sequence
  Synthetic polynucleotide
uaggagggcccugggccccuu

SEQ ID NO: 2131 - RNA, 21 nt, Artificial Sequence
  Synthetic polynucleotide
auaggagggcccugggcccuu

SEQ ID NO: 2132 - RNA, 21 nt, Artificial Sequence
  Synthetic polynucleotide
acacaugccagucaccucauu

SEQ ID NO: 2133 - RNA, 21 nt, Artificial Sequence
  Synthetic polynucleotide
cauaggagggcccugggccuu

SEQ ID NO: 2134 - RNA, 21 nt, Artificial Sequence
  Synthetic polynucleotide
ccauaggagggcccugggcuu

SEQ ID NO: 2135 - RNA, 21 nt, Artificial Sequence
  Synthetic polynucleotide
uccauaggagggcccuggguu

SEQ ID NO: 2136 - RNA, 21 nt, Artificial Sequence
  Synthetic polynucleotide
guccauaggagggcccugguu

SEQ ID NO: 2137 - RNA, 21 nt, Artificial Sequence
  Synthetic polynucleotide
gguccauaggagggcccuguu

SEQ ID NO: 2138 - RNA, 21 nt, Artificial Sequence
  Synthetic polynucleotide
ggguccauaggagggcccuuu

SEQ ID NO: 2139 - RNA, 21 nt, Artificial Sequence
  Synthetic polynucleotide
aggguccauaggagggcccuu

SEQ ID NO: 2140 - RNA, 21 nt, Artificial Sequence
  Synthetic polynucleotide
caggguccauaggagggccuu

SEQ ID NO: 2141 - RNA, 21 nt, Artificial Sequence
  Synthetic polynucleotide
gcaggguccauaggagggcuu

SEQ ID NO: 2142 - RNA, 21 nt, Artificial Sequence
  Synthetic polynucleotide
ggcaggguccauaggaggguu

SEQ ID NO: 2143 - RNA, 21 nt, Artificial Sequence
  Synthetic polynucleotide
cacacaugccagucaccucuu

SEQ ID NO: 2144 - RNA, 21 nt, Artificial Sequence
  Synthetic polynucleotide
gggcaggguccauaggagguu

SEQ ID NO: 2145 - RNA, 21 nt, Artificial Sequence
  Synthetic polynucleotide
cgggcaggguccauaggaguu

SEQ ID NO: 2146 - RNA, 21 nt, Artificial Sequence
  Synthetic polynucleotide
gcgggcaggguccauaggauu

SEQ ID NO: 2147 - RNA, 21 nt, Artificial Sequence
  Synthetic polynucleotide
agcgggcaggguccauagguu

SEQ ID NO: 2148 - RNA, 21 nt, Artificial Sequence
  Synthetic polynucleotide
gagcgggcaggguccauaguu

SEQ ID NO: 2149 - RNA, 21 nt, Artificial Sequence
  Synthetic polynucleotide
ggagcgggcaggguccauauu

SEQ ID NO: 2150 - RNA, 21 nt, Artificial Sequence
  Synthetic polynucleotide
gggagcgggcaggguccauuu

SEQ ID NO: 2151 - RNA, 21 nt, Artificial Sequence
  Synthetic polynucleotide
ggggagcgggcaggguccauu

SEQ ID NO: 2152 - RNA, 21 nt, Artificial Sequence
  Synthetic polynucleotide
aggggagcgggcaggguccuu

SEQ ID NO: 2153 - RNA, 21 nt, Artificial Sequence
  Synthetic polynucleotide
gaggggagcgggcagggucuu

SEQ ID NO: 2154 - RNA, 21 nt, Artificial Sequence
  Synthetic polynucleotide
ccacacaugccagucaccuuu

SEQ ID NO: 2155 - RNA, 21 nt, Artificial Sequence
  Synthetic polynucleotide
ggaggggagcgggcaggguuu

SEQ ID NO: 2156 - RNA, 21 nt, Artificial Sequence
  Synthetic polynucleotide
gggaggggagcgggcaggguu

SEQ ID NO: 2157 - RNA, 21 nt, Artificial Sequence
  Synthetic polynucleotide
ugggaggggagcgggcagguu

SEQ ID NO: 2158 - RNA, 21 nt, Artificial Sequence
  Synthetic polynucleotide
augggaggggagcgggcaguu

SEQ ID NO: 2159 - RNA, 21 nt, Artificial Sequence
  Synthetic polynucleotide
aaugggaggggagcgggcauu

SEQ ID NO: 2160 - RNA, 21 nt, Artificial Sequence
  Synthetic polynucleotide
caaugggaggggagcgggcuu

SEQ ID NO: 2161 - RNA, 21 nt, Artificial Sequence
  Synthetic polynucleotide
acaaugggaggggagcggguu

SEQ ID NO: 2162 - RNA, 21 nt, Artificial Sequence
  Synthetic polynucleotide
gacaaugggaggggagcgguu

SEQ ID NO: 2163 - RNA, 21 nt, Artificial Sequence
  Synthetic polynucleotide
ggacaaugggaggggagcguu

SEQ ID NO: 2164 - RNA, 21 nt, Artificial Sequence
  Synthetic polynucleotide
uggacaaugggaggggagcuu

SEQ ID NO: 2165 - RNA, 21 nt, Artificial Sequence
  Synthetic polynucleotide
guggacaaugggaggggaguu

SEQ ID NO: 2166 - RNA, 21 nt, Artificial Sequence
  Synthetic polynucleotide
cccacacaugccagucaccuu

SEQ ID NO: 2167 - RNA, 21 nt, Artificial Sequence
  Synthetic polynucleotide
cguggacaaugggaggggauu

SEQ ID NO: 2168 - RNA, 21 nt, Artificial Sequence
  Synthetic polynucleotide
ccguggacaaugggagggguu

SEQ ID NO: 2169 - RNA, 21 nt, Artificial Sequence
  Synthetic polynucleotide
gccguggacaaugggaggguu

SEQ ID NO: 2170 - RNA, 21 nt, Artificial Sequence
  Synthetic polynucleotide
agccguggacaaugggagguu

SEQ ID NO: 2171 - RNA, 21 nt, Artificial Sequence
  Synthetic polynucleotide
cagccguggacaaugggaguu

SEQ ID NO: 2172 - RNA, 21 nt, Artificial Sequence
  Synthetic polynucleotide
acagccguggacaaugggauu

SEQ ID NO: 2173 - RNA, 21 nt, Artificial Sequence
  Synthetic polynucleotide
gacagccguggacaauggguu

SEQ ID NO: 2174 - RNA, 21 nt, Artificial Sequence
  Synthetic polynucleotide
ggacagccguggacaaugguu

SEQ ID NO: 2175 - RNA, 21 nt, Artificial Sequence
  Synthetic polynucleotide
cggacagccguggacaauguu

SEQ ID NO: 2176 - RNA, 21 nt, Artificial Sequence
  Synthetic polynucleotide
gcggacagccguggacaauuu

SEQ ID NO: 2177 - RNA, 21 nt, Artificial Sequence
  Synthetic polynucleotide
ccccacacaugccagucacuu

SEQ ID NO: 2178 - RNA, 21 nt, Artificial Sequence
  Synthetic polynucleotide
ggcggacagccguggacaauu

SEQ ID NO: 2179 - RNA, 21 nt, Artificial Sequence
  Synthetic polynucleotide
gggcggacagccguggacauu

SEQ ID NO: 2180 - RNA, 21 nt, Artificial Sequence
  Synthetic polynucleotide
ugggcggacagccguggacuu

SEQ ID NO: 2181 - RNA, 21 nt, Artificial Sequence
  Synthetic polynucleotide
gugggcggacagccguggauu

SEQ ID NO: 2182 - RNA, 21 nt, Artificial Sequence
  Synthetic polynucleotide
ggugggcggacagccgugguu

SEQ ID NO: 2183 - RNA, 21 nt, Artificial Sequence
  Synthetic polynucleotide
gggugggcggacagccguguu

SEQ ID NO: 2184 - RNA, 21 nt, Artificial Sequence
  Synthetic polynucleotide
ggggugggcggacagccguuu

SEQ ID NO: 2185 - RNA, 21 nt, Artificial Sequence
  Synthetic polynucleotide
gggggugggcggacagccguu

SEQ ID NO: 2186 - RNA, 21 nt, Artificial Sequence
  Synthetic polynucleotide
ugggggugggcggacagccuu

SEQ ID NO: 2187 - RNA, 21 nt, Artificial Sequence
  Synthetic polynucleotide
augggggugggcggacagcuu

SEQ ID NO: 2188 - RNA, 21 nt, Artificial Sequence
  Synthetic polynucleotide
cccccacacaugccagucauu

SEQ ID NO: 2189 - RNA, 21 nt, Artificial Sequence
  Synthetic polynucleotide
aaugggggugggcggacaguu

SEQ ID NO: 2190 - RNA, 21 nt, Artificial Sequence
  Synthetic polynucleotide
gaaugggggugggcggacauu

SEQ ID NO: 2191 - RNA, 21 nt, Artificial Sequence
  Synthetic polynucleotide
agaaugggggugggcggacuu

SEQ ID NO: 2192 - RNA, 21 nt, Artificial Sequence
  Synthetic polynucleotide
gagaaugggggugggcggauu

SEQ ID NO: 2193 - RNA, 21 nt, Artificial Sequence
  Synthetic polynucleotide
ggagaaugggggugggcgguu

SEQ ID NO: 2194 - RNA, 21 nt, Artificial Sequence
  Synthetic polynucleotide
uggagaaugggggugggcguu

SEQ ID NO: 2195 - RNA, 21 nt, Artificial Sequence
  Synthetic polynucleotide
uuggagaaugggggugggcuu

SEQ ID NO: 2196 - RNA, 21 nt, Artificial Sequence
  Synthetic polynucleotide
cuuggagaauggggguggguu

SEQ ID NO: 2197 - RNA, 21 nt, Artificial Sequence
  Synthetic polynucleotide
gcuuggagaaugggggugguu

SEQ ID NO: 2198 - RNA, 21 nt, Artificial Sequence
  Synthetic polynucleotide
agcuuggagaauggggguguu

SEQ ID NO: 2199 - RNA, 21 nt, Artificial Sequence
  Synthetic polynucleotide
gcccccacacaugccagucuu

SEQ ID NO: 2200 - RNA, 21 nt, Artificial Sequence
  Synthetic polynucleotide
aagcuuggagaauggggguuu

SEQ ID NO: 2201 - RNA, 21 nt, Artificial Sequence
  Synthetic polynucleotide
gaagcuuggagaauggggguu

SEQ ID NO: 2202 - RNA, 21 nt, Artificial Sequence
  Synthetic polynucleotide
ugaagcuuggagaaugggguu

SEQ ID NO: 2203 - RNA, 21 nt, Artificial Sequence
  Synthetic polynucleotide
cugaagcuuggagaauggguu

SEQ ID NO: 2204 - RNA, 21 nt, Artificial Sequence
  Synthetic polynucleotide
gcugaagcuuggagaaugguu

SEQ ID NO: 2205 - RNA, 21 nt, Artificial Sequence
  Synthetic polynucleotide
ggcugaagcuuggagaauguu

SEQ ID NO: 2206 - RNA, 21 nt, Artificial Sequence
  Synthetic polynucleotide
gggcugaagcuuggagaauuu

SEQ ID NO: 2207 - RNA, 21 nt, Artificial Sequence
  Synthetic polynucleotide
ggggcugaagcuuggagaauu

SEQ ID NO: 2208 - RNA, 21 nt, Artificial Sequence
  Synthetic polynucleotide
gggggcugaagcuuggagauu

SEQ ID NO: 2209 - RNA, 21 nt, Artificial Sequence
  Synthetic polynucleotide
agggggcugaagcuuggaguu

SEQ ID NO: 2210 - RNA, 21 nt, Artificial Sequence
  Synthetic polynucleotide
ugcccccacacaugccaguuu

SEQ ID NO: 2211 - RNA, 21 nt, Artificial Sequence
  Synthetic polynucleotide
gagggggcugaagcuuggauu

SEQ ID NO: 2212 - RNA, 21 nt, Artificial Sequence
  Synthetic polynucleotide
ggagggggcugaagcuugguu

SEQ ID NO: 2213 - RNA, 21 nt, Artificial Sequence
  Synthetic polynucleotide
aggagggggcugaagcuuguu

SEQ ID NO: 2214 - RNA, 21 nt, Artificial Sequence
  Synthetic polynucleotide
aaggagggggcugaagcuuuu

SEQ ID NO: 2215 - RNA, 21 nt, Artificial Sequence
  Synthetic polynucleotide
uaaggagggggcugaagcuuu

SEQ ID NO: 2216 - RNA, 21 nt, Artificial Sequence
  Synthetic polynucleotide
cuaaggagggggcugaagcuu

SEQ ID NO: 2217 - RNA, 21 nt, Artificial Sequence
  Synthetic polynucleotide
acuaaggagggggcugaaguu

SEQ ID NO: 2218 - RNA, 21 nt, Artificial Sequence
  Synthetic polynucleotide
aacuaaggagggggcugaauu

SEQ ID NO: 2219 - RNA, 21 nt, Artificial Sequence
  Synthetic polynucleotide
gaacuaaggagggggcugauu

SEQ ID NO: 2220 - RNA, 21 nt, Artificial Sequence
  Synthetic polynucleotide
cgaacuaaggagggggcuguu

SEQ ID NO: 2221 - RNA, 21 nt, Artificial Sequence
  Synthetic polynucleotide
uugcccccacacaugccaguu

SEQ ID NO: 2222 - RNA, 21 nt, Artificial Sequence
  Synthetic polynucleotide
ccgaacuaaggagggggcuuu

SEQ ID NO: 2223 - RNA, 21 nt, Artificial Sequence
  Synthetic polynucleotide
gccgaacuaaggagggggcuu

SEQ ID NO: 2224 - RNA, 21 nt, Artificial Sequence
  Synthetic polynucleotide
ugccgaacuaaggaggggguu

SEQ ID NO: 2225 - RNA, 21 nt, Artificial Sequence
  Synthetic polynucleotide
augccgaacuaaggagggguu

SEQ ID NO: 2226 - RNA, 21 nt, Artificial Sequence
  Synthetic polynucleotide
gaugccgaacuaaggaggguu

SEQ ID NO: 2227 - RNA, 21 nt, Artificial Sequence
  Synthetic polynucleotide
agaugccgaacuaaggagguu

SEQ ID NO: 2228 - RNA, 21 nt, Artificial Sequence
  Synthetic polynucleotide
cagaugccgaacuaaggaguu

SEQ ID NO: 2229 - RNA, 21 nt, Artificial Sequence
  Synthetic polynucleotide
gcagaugccgaacuaaggauu

SEQ ID NO: 2230 - RNA, 21 nt, Artificial Sequence
  Synthetic polynucleotide
ugcagaugccgaacuaagguu

SEQ ID NO: 2231 - RNA, 21 nt, Artificial Sequence
  Synthetic polynucleotide
gugcagaugccgaacuaaguu

SEQ ID NO: 2232 - RNA, 21 nt, Artificial Sequence
  Synthetic polynucleotide
guugcccccacacaugccauu

SEQ ID NO: 2233 - RNA, 21 nt, Artificial Sequence
  Synthetic polynucleotide
ugugcagaugccgaacuaauu

SEQ ID NO: 2234 - RNA, 21 nt, Artificial Sequence
  Synthetic polynucleotide
cugugcagaugccgaacuauu

SEQ ID NO: 2235 - RNA, 21 nt, Artificial Sequence
  Synthetic polynucleotide
gcugugcagaugccgaacuuu

SEQ ID NO: 2236 - RNA, 21 nt, Artificial Sequence
  Synthetic polynucleotide
ugcugugcagaugccgaacuu

SEQ ID NO: 2237 - RNA, 21 nt, Artificial Sequence
  Synthetic polynucleotide
gugcugugcagaugccgaauu

SEQ ID NO: 2238 - RNA, 21 nt, Artificial Sequence
  Synthetic polynucleotide
agugcugugcagaugccgauu

SEQ ID NO: 2239 - RNA, 21 nt, Artificial Sequence
  Synthetic polynucleotide
cucuuccgugcaccguuuguu

SEQ ID NO: 2240 - RNA, 21 nt, Artificial Sequence
  Synthetic polynucleotide
cagugcugugcagaugccguu

SEQ ID NO: 2241 - RNA, 21 nt, Artificial Sequence
  Synthetic polynucleotide
ucagugcugugcagaugccuu

SEQ ID NO: 2242 - RNA, 21 nt, Artificial Sequence
  Synthetic polynucleotide
uucagugcugugcagaugcuu

SEQ ID NO: 2243 - RNA, 21 nt, Artificial Sequence
  Synthetic polynucleotide
cuucagugcugugcagauguu

SEQ ID NO: 2244 - RNA, 21 nt, Artificial Sequence
  Synthetic polynucleotide
uguugcccccacacaugccuu

SEQ ID NO: 2245 - RNA, 21 nt, Artificial Sequence
  Synthetic polynucleotide
ucuucagugcugugcagauuu

SEQ ID NO: 2246 - RNA, 21 nt, Artificial Sequence
  Synthetic polynucleotide
uucuucagugcugugcagauu

SEQ ID NO: 2247 - RNA, 21 nt, Artificial Sequence
  Synthetic polynucleotide
guucuucagugcugugcaguu

SEQ ID NO: 2248 - RNA, 21 nt, Artificial Sequence
  Synthetic polynucleotide
gguucuucagugcugugcauu

SEQ ID NO: 2249 - RNA, 21 nt, Artificial Sequence
  Synthetic polynucleotide
agguucuucagugcugugcuu

SEQ ID NO: 2250 - RNA, 21 nt, Artificial Sequence
  Synthetic polynucleotide
cagguucuucagugcuguguu

SEQ ID NO: 2251 - RNA, 21 nt, Artificial Sequence
  Synthetic polynucleotide
ccagguucuucagugcuguuu

SEQ ID NO: 2252 - RNA, 21 nt, Artificial Sequence
  Synthetic polynucleotide
cccagguucuucagugcuguu

SEQ ID NO: 2253 - RNA, 21 nt, Artificial Sequence
  Synthetic polynucleotide
ucccagguucuucagugcuuu

SEQ ID NO: 2254 - RNA, 21 nt, Artificial Sequence
  Synthetic polynucleotide
uucccagguucuucagugcuu

SEQ ID NO: 2255 - RNA, 21 nt, Artificial Sequence
  Synthetic polynucleotide
guguugcccccacacaugcuu

SEQ ID NO: 2256 - RNA, 21 nt, Artificial Sequence
  Synthetic polynucleotide
auucccagguucuucaguguu

SEQ ID NO: 2257 - RNA, 21 nt, Artificial Sequence
  Synthetic polynucleotide
gauucccagguucuucaguuu

SEQ ID NO: 2258 - RNA, 21 nt, Artificial Sequence
  Synthetic polynucleotide
ugauucccagguucuucaguu

SEQ ID NO: 2259 - RNA, 21 nt, Artificial Sequence
  Synthetic polynucleotide
cugauucccagguucuucauu

SEQ ID NO: 2260 - RNA, 21 nt, Artificial Sequence
  Synthetic polynucleotide
ucugauucccagguucuucuu

SEQ ID NO: 2261 - RNA, 21 nt, Artificial Sequence
  Synthetic polynucleotide
gucugauucccagguucuuuu

SEQ ID NO: 2262 - RNA, 21 nt, Artificial Sequence
  Synthetic polynucleotide
ggucugauucccagguucuuu

SEQ ID NO: 2263 - RNA, 21 nt, Artificial Sequence
  Synthetic polynucleotide
gggucugauucccagguucuu

SEQ ID NO: 2264 - RNA, 21 nt, Artificial Sequence
  Synthetic polynucleotide
agggucugauucccagguuuu

SEQ ID NO: 2265 - RNA, 21 nt, Artificial Sequence
  Synthetic polynucleotide
cagggucugauucccagguuu

SEQ ID NO: 2266 - RNA, 21 nt, Artificial Sequence
  Synthetic polynucleotide
cguguugcccccacacauguu

SEQ ID NO: 2267 - RNA, 21 nt, Artificial Sequence
  Synthetic polynucleotide
ucagggucugauucccagguu

SEQ ID NO: 2268 - RNA, 21 nt, Artificial Sequence
  Synthetic polynucleotide
cucagggucugauucccaguu

SEQ ID NO: 2269 - RNA, 21 nt, Artificial Sequence
  Synthetic polynucleotide
ucucagggucugauucccauu

SEQ ID NO: 2270 - RNA, 21 nt, Artificial Sequence
  Synthetic polynucleotide
gucucagggucugauucccuu

SEQ ID NO: 2271 - RNA, 21 nt, Artificial Sequence
  Synthetic polynucleotide
ggucucagggucugauuccuu

SEQ ID NO: 2272 - RNA, 21 nt, Artificial Sequence
  Synthetic polynucleotide
gggucucagggucugauucuu

SEQ ID NO: 2273 - RNA, 21 nt, Artificial Sequence
  Synthetic polynucleotide
agggucucagggucugauuuu

SEQ ID NO: 2274 - RNA, 21 nt, Artificial Sequence
  Synthetic polynucleotide
cagggucucagggucugauuu

SEQ ID NO: 2275 - RNA, 21 nt, Artificial Sequence
  Synthetic polynucleotide
ucagggucucagggucugauu

SEQ ID NO: 2276 - RNA, 21 nt, Artificial Sequence
  Synthetic polynucleotide
cucagggucucagggucuguu

SEQ ID NO: 2277 - RNA, 21 nt, Artificial Sequence
  Synthetic polynucleotide
ucguguugcccccacacauuu

SEQ ID NO: 2278 - RNA, 21 nt, Artificial Sequence
  Synthetic polynucleotide
gcucagggucucagggucuuu

SEQ ID NO: 2279 - RNA, 21 nt, Artificial Sequence
  Synthetic polynucleotide
ugcucagggucucagggucuu

SEQ ID NO: 2280 - RNA, 21 nt, Artificial Sequence
  Synthetic polynucleotide
uugcucagggucucaggguuu

SEQ ID NO: 2281 - RNA, 21 nt, Artificial Sequence
  Synthetic polynucleotide
auugcucagggucucaggguu

SEQ ID NO: 2282 - RNA, 21 nt, Artificial Sequence
  Synthetic polynucleotide
gauugcucagggucucagguu

SEQ ID NO: 2283 - RNA, 21 nt, Artificial Sequence
  Synthetic polynucleotide
ggauugcucagggucucaguu

SEQ ID NO: 2284 - RNA, 21 nt, Artificial Sequence
  Synthetic polynucleotide
gggauugcucagggucucauu

SEQ ID NO: 2285 - RNA, 21 nt, Artificial Sequence
  Synthetic polynucleotide
ugggauugcucagggucucuu

SEQ ID NO: 2286 - RNA, 21 nt, Artificial Sequence
  Synthetic polynucleotide
cugggauugcucagggucuuu

SEQ ID NO: 2287 - RNA, 21 nt, Artificial Sequence
  Synthetic polynucleotide
ccugggauugcucagggucuu

SEQ ID NO: 2288 - RNA, 21 nt, Artificial Sequence
  Synthetic polynucleotide
accugggauugcucaggguuu

SEQ ID NO: 2289 - RNA, 21 nt, Artificial Sequence
  Synthetic polynucleotide
aucguguugcccccacacauu

SEQ ID NO: 2290 - RNA, 21 nt, Artificial Sequence
  Synthetic polynucleotide
gaccugggauugcucaggguu

SEQ ID NO: 2291 - RNA, 21 nt, Artificial Sequence
  Synthetic polynucleotide
ggaccugggauugcucagguu

SEQ ID NO: 2292 - RNA, 21 nt, Artificial Sequence
  Synthetic polynucleotide
uggaccugggauugcucaguu

SEQ ID NO: 2293 - RNA, 21 nt, Artificial Sequence
  Synthetic polynucleotide
cuggaccugggauugcucauu

SEQ ID NO: 2294 - RNA, 21 nt, Artificial Sequence
  Synthetic polynucleotide
gcuggaccugggauugcucuu

SEQ ID NO: 2295 - RNA, 21 nt, Artificial Sequence
  Synthetic polynucleotide
cgcuggaccugggauugcuuu

SEQ ID NO: 2296 - RNA, 21 nt, Artificial Sequence
  Synthetic polynucleotide
gcgcuggaccugggauugcuu

SEQ ID NO: 2297 - RNA, 21 nt, Artificial Sequence
  Synthetic polynucleotide
ggcgcuggaccugggauuguu

SEQ ID NO: 2298 - RNA, 21 nt, Artificial Sequence
  Synthetic polynucleotide
uggcgcuggaccugggauuuu

SEQ ID NO: 2299 - RNA, 21 nt, Artificial Sequence
  Synthetic polynucleotide
cuggcgcuggaccugggauuu

SEQ ID NO: 2300 - RNA, 21 nt, Artificial Sequence
  Synthetic polynucleotide
aaucguguugcccccacacuu

SEQ ID NO: 2301 - RNA, 21 nt, Artificial Sequence
  Synthetic polynucleotide
gcuggcgcuggaccugggauu

SEQ ID NO: 2302 - RNA, 21 nt, Artificial Sequence
  Synthetic polynucleotide
ggcuggcgcuggaccuggguu

SEQ ID NO: 2303 - RNA, 21 nt, Artificial Sequence
  Synthetic polynucleotide
gggcuggcgcuggaccugguu

SEQ ID NO: 2304 - RNA, 21 nt, Artificial Sequence
  Synthetic polynucleotide
agggcuggcgcuggaccuguu

SEQ ID NO: 2305 - RNA, 21 nt, Artificial Sequence
  Synthetic polynucleotide
uagggcuggcgcuggaccuuu

SEQ ID NO: 2306 - RNA, 21 nt, Artificial Sequence
  Synthetic polynucleotide
auagggcuggcgcuggaccuu

SEQ ID NO: 2307 - RNA, 21 nt, Artificial Sequence
  Synthetic polynucleotide
gauagggcuggcgcuggacuu

SEQ ID NO: 2308 - RNA, 21 nt, Artificial Sequence
  Synthetic polynucleotide
ugauagggcuggcgcuggauu

SEQ ID NO: 2309 - RNA, 21 nt, Artificial Sequence
  Synthetic polynucleotide
augauagggcuggcgcugguu

SEQ ID NO: 2310 - RNA, 21 nt, Artificial Sequence
  Synthetic polynucleotide
caugauagggcuggcgcuguu

SEQ ID NO: 2311 - RNA, 21 nt, Artificial Sequence
  Synthetic polynucleotide
gaaucguguugcccccacauu

SEQ ID NO: 2312 - RNA, 21 nt, Artificial Sequence
  Synthetic polynucleotide
ucaugauagggcuggcgcuuu

SEQ ID NO: 2313 - RNA, 21 nt, Artificial Sequence
  Synthetic polynucleotide
gucaugauagggcuggcgcuu

SEQ ID NO: 2314 - RNA, 21 nt, Artificial Sequence
  Synthetic polynucleotide
ggucaugauagggcuggcguu

SEQ ID NO: 2315 - RNA, 21 nt, Artificial Sequence
  Synthetic polynucleotide
uggucaugauagggcuggcuu

SEQ ID NO: 2316 - RNA, 21 nt, Artificial Sequence
  Synthetic polynucleotide
uuggucaugauagggcugguu

SEQ ID NO: 2317 - RNA, 21 nt, Artificial Sequence
  Synthetic polynucleotide
cuuggucaugauagggcuguu

SEQ ID NO: 2318 - RNA, 21 nt, Artificial Sequence
  Synthetic polynucleotide
ccuuggucaugauagggcuuu

SEQ ID NO: 2319 - RNA, 21 nt, Artificial Sequence
  Synthetic polynucleotide
uccuuggucaugauagggcuu

SEQ ID NO: 2320 - RNA, 21 nt, Artificial Sequence
  Synthetic polynucleotide
cuccuuggucaugauaggguu

SEQ ID NO: 2321 - RNA, 21 nt, Artificial Sequence
  Synthetic polynucleotide
acuccuuggucaugauagguu

SEQ ID NO: 2322 - RNA, 21 nt, Artificial Sequence
  Synthetic polynucleotide
agaaucguguugcccccacuu

SEQ ID NO: 2323 - RNA, 21 nt, Artificial Sequence
  Synthetic polynucleotide
uacuccuuggucaugauaguu

SEQ ID NO: 2324 - RNA, 21 nt, Artificial Sequence
  Synthetic polynucleotide
auacuccuuggucaugauauu

SEQ ID NO: 2325 - RNA, 21 nt, Artificial Sequence
  Synthetic polynucleotide
gauacuccuuggucaugauuu

SEQ ID NO: 2326 - RNA, 21 nt, Artificial Sequence
  Synthetic polynucleotide
ugauacuccuuggucaugauu

SEQ ID NO: 2327 - RNA, 21 nt, Artificial Sequence
  Synthetic polynucleotide
uugauacuccuuggucauguu

SEQ ID NO: 2328 - RNA, 21 nt, Artificial Sequence
  Synthetic polynucleotide
cuugauacuccuuggucauuu

SEQ ID NO: 2329 - RNA, 21 nt, Artificial Sequence
  Synthetic polynucleotide
ucuugauacuccuuggucauu

SEQ ID NO: 2330 - RNA, 21 nt, Artificial Sequence
  Synthetic polynucleotide
gucuugauacuccuuggucuu

SEQ ID NO: 2331 - RNA, 21 nt, Artificial Sequence
  Synthetic polynucleotide
ggucuugauacuccuugguuu

SEQ ID NO: 2332 - RNA, 21 nt, Artificial Sequence
  Synthetic polynucleotide
aggucuugauacuccuugguu

SEQ ID NO: 2333 - RNA, 21 nt, Artificial Sequence
  Synthetic polynucleotide
gagaaucguguugcccccauu

SEQ ID NO: 2334 - RNA, 21 nt, Artificial Sequence
  Synthetic polynucleotide
aaggucuugauacuccuuguu

SEQ ID NO: 2335 - RNA, 21 nt, Artificial Sequence
  Synthetic polynucleotide
gaaggucuugauacuccuuuu

SEQ ID NO: 2336 - RNA, 21 nt, Artificial Sequence
  Synthetic polynucleotide
ugaaggucuugauacuccuuu

SEQ ID NO: 2337 - RNA, 21 nt, Artificial Sequence
  Synthetic polynucleotide
cugaaggucuugauacuccuu

SEQ ID NO: 2338 - RNA, 21 nt, Artificial Sequence
  Synthetic polynucleotide
gcugaaggucuugauacucuu

SEQ ID NO: 2339 - RNA, 21 nt, Artificial Sequence
  Synthetic polynucleotide
ugcugaaggucuugauacuuu

SEQ ID NO: 2340 - RNA, 21 nt, Artificial Sequence
  Synthetic polynucleotide
augcugaaggucuugauacuu

SEQ ID NO: 2341 - RNA, 21 nt, Artificial Sequence
  Synthetic polynucleotide
gaugcugaaggucuugauauu

SEQ ID NO: 2342 - RNA, 21 nt, Artificial Sequence
  Synthetic polynucleotide
agaugcugaaggucuugauuu

SEQ ID NO: 2343 - RNA, 21 nt, Artificial Sequence
  Synthetic polynucleotide
cagaugcugaaggucuugauu

SEQ ID NO: 2344 - RNA, 21 nt, Artificial Sequence
  Synthetic polynucleotide
ggagaaucguguugcccccuu

SEQ ID NO: 2345 - RNA, 21 nt, Artificial Sequence
  Synthetic polynucleotide
ccagaugcugaaggucuuguu

SEQ ID NO: 2346 - RNA, 21 nt, Artificial Sequence
  Synthetic polynucleotide
uccagaugcugaaggucuuuu

SEQ ID NO: 2347 - RNA, 21 nt, Artificial Sequence
  Synthetic polynucleotide
guccagaugcugaaggucuuu

SEQ ID NO: 2348 - RNA, 21 nt, Artificial Sequence
  Synthetic polynucleotide
uguccagaugcugaaggucuu

SEQ ID NO: 2349 - RNA, 21 nt, Artificial Sequence
  Synthetic polynucleotide
uuguccagaugcugaagguuu

SEQ ID NO: 2350 - RNA, 21 nt, Artificial Sequence
  Synthetic polynucleotide
auuguccagaugcugaagguu

SEQ ID NO: 2351 - RNA, 21 nt, Artificial Sequence
  Synthetic polynucleotide
acucuuccgugcaccguuuuu

SEQ ID NO: 2352 - RNA, 21 nt, Artificial Sequence
  Synthetic polynucleotide
cauuguccagaugcugaaguu

SEQ ID NO: 2353 - RNA, 21 nt, Artificial Sequence
  Synthetic polynucleotide
ucauuguccagaugcugaauu

SEQ ID NO: 2354 - RNA, 21 nt, Artificial Sequence
  Synthetic polynucleotide
cucauuguccagaugcugauu

SEQ ID NO: 2355 - RNA, 21 nt, Artificial Sequence
  Synthetic polynucleotide
ccucauuguccagaugcuguu

SEQ ID NO: 2356 - RNA, 21 nt, Artificial Sequence
  Synthetic polynucleotide
aggagaaucguguugccccuu

SEQ ID NO: 2357 - RNA, 21 nt, Artificial Sequence
  Synthetic polynucleotide
uccucauuguccagaugcuuu

SEQ ID NO: 2358 - RNA, 21 nt, Artificial Sequence
  Synthetic polynucleotide
cuccucauuguccagaugcuu

SEQ ID NO: 2359 - RNA, 21 nt, Artificial Sequence
  Synthetic polynucleotide
ucuccucauuguccagauguu

SEQ ID NO: 2360 - RNA, 21 nt, Artificial Sequence
  Synthetic polynucleotide
cucuccucauuguccagauuu

SEQ ID NO: 2361 - RNA, 21 nt, Artificial Sequence
  Synthetic polynucleotide
acucuccucauuguccagauu

SEQ ID NO: 2362 - RNA, 21 nt, Artificial Sequence
  Synthetic polynucleotide
cacucuccucauuguccaguu

SEQ ID NO: 2363 - RNA, 21 nt, Artificial Sequence
  Synthetic polynucleotide
ucacucuccucauuguccauu

SEQ ID NO: 2364 - RNA, 21 nt, Artificial Sequence
  Synthetic polynucleotide
gucacucuccucauuguccuu

SEQ ID NO: 2365 - RNA, 21 nt, Artificial Sequence
  Synthetic polynucleotide
ggucacucuccucauugucuu

SEQ ID NO: 2366 - RNA, 21 nt, Artificial Sequence
  Synthetic polynucleotide
uggucacucuccucauuguuu

SEQ ID NO: 2367 - RNA, 21 nt, Artificial Sequence
  Synthetic polynucleotide
gaggagaaucguguugcccuu

SEQ ID NO: 2368 - RNA, 21 nt, Artificial Sequence
  Synthetic polynucleotide
guggucacucuccucauuguu

SEQ ID NO: 2369 - RNA, 21 nt, Artificial Sequence
  Synthetic polynucleotide
gguggucacucuccucauuuu

SEQ ID NO: 2370 - RNA, 21 nt, Artificial Sequence
  Synthetic polynucleotide
ugguggucacucuccucauuu

SEQ ID NO: 2371 - RNA, 21 nt, Artificial Sequence
  Synthetic polynucleotide
augguggucacucuccucauu

SEQ ID NO: 2372 - RNA, 21 nt, Artificial Sequence
  Synthetic polynucleotide
gaugguggucacucuccucuu

SEQ ID NO: 2373 - RNA, 21 nt, Artificial Sequence
  Synthetic polynucleotide
ugaugguggucacucuccuuu

SEQ ID NO: 2374 - RNA, 21 nt, Artificial Sequence
  Synthetic polynucleotide
cugaugguggucacucuccuu

SEQ ID NO: 2375 - RNA, 21 nt, Artificial Sequence
  Synthetic polynucleotide
gcugaugguggucacucucuu

SEQ ID NO: 2376 - RNA, 21 nt, Artificial Sequence
  Synthetic polynucleotide
agcugaugguggucacucuuu

SEQ ID NO: 2377 - RNA, 21 nt, Artificial Sequence
  Synthetic polynucleotide
gagcugaugguggucacucuu

SEQ ID NO: 2378 - RNA, 21 nt, Artificial Sequence
  Synthetic polynucleotide
ggaggagaaucguguugccuu

SEQ ID NO: 2379 - RNA, 21 nt, Artificial Sequence
  Synthetic polynucleotide
ugagcugaugguggucacuuu

SEQ ID NO: 2380 - RNA, 21 nt, Artificial Sequence
  Synthetic polynucleotide
cugagcugaugguggucacuu

SEQ ID NO: 2381 - RNA, 21 nt, Artificial Sequence
  Synthetic polynucleotide
ucugagcugaugguggucauu

SEQ ID NO: 2382 - RNA, 21 nt, Artificial Sequence
  Synthetic polynucleotide
uucugagcugaugguggucuu

SEQ ID NO: 2383 - RNA, 21 nt, Artificial Sequence
  Synthetic polynucleotide
uuucugagcugauggugguuu

SEQ ID NO: 2384 - RNA, 21 nt, Artificial Sequence
  Synthetic polynucleotide
uuuucugagcugauggugguu

SEQ ID NO: 2385 - RNA, 21 nt, Artificial Sequence
  Synthetic polynucleotide
cuuuucugagcugaugguguu

SEQ ID NO: 2386 - RNA, 21 nt, Artificial Sequence
  Synthetic polynucleotide
ccuuuucugagcugaugguuu

SEQ ID NO: 2387 - RNA, 21 nt, Artificial Sequence
  Synthetic polynucleotide
cccuuuucugagcugaugguu

SEQ ID NO: 2388 - RNA, 21 nt, Artificial Sequence
  Synthetic polynucleotide
gcccuuuucugagcugauguu

SEQ ID NO: 2389 - RNA, 21 nt, Artificial Sequence
  Synthetic polynucleotide
gggaggagaaucguguugcuu

SEQ ID NO: 2390 - RNA, 21 nt, Artificial Sequence
  Synthetic polynucleotide
ggcccuuuucugagcugauuu

SEQ ID NO: 2391 - RNA, 21 nt, Artificial Sequence
  Synthetic polynucleotide
uggcccuuuucugagcugauu

SEQ ID NO: 2392 - RNA, 21 nt, Artificial Sequence
  Synthetic polynucleotide
guggcccuuuucugagcuguu

SEQ ID NO: 2393 - RNA, 21 nt, Artificial Sequence
  Synthetic polynucleotide
gguggcccuuuucugagcuuu

SEQ ID NO: 2394 - RNA, 21 nt, Artificial Sequence
  Synthetic polynucleotide
agguggcccuuuucugagcuu

SEQ ID NO: 2395 - RNA, 21 nt, Artificial Sequence
  Synthetic polynucleotide
gagguggcccuuuucugaguu

SEQ ID NO: 2396 - RNA, 21 nt, Artificial Sequence
  Synthetic polynucleotide
ggagguggcccuuuucugauu

SEQ ID NO: 2397 - RNA, 21 nt, Artificial Sequence
  Synthetic polynucleotide
aggagguggcccuuuucuguu

SEQ ID NO: 2398 - RNA, 21 nt, Artificial Sequence
  Synthetic polynucleotide
gaggagguggcccuuuucuuu

SEQ ID NO: 2399 - RNA, 21 nt, Artificial Sequence
  Synthetic polynucleotide
ggaggagguggcccuuuucuu

SEQ ID NO: 2400 - RNA, 21 nt, Artificial Sequence
  Synthetic polynucleotide
agggaggagaaucguguuguu

SEQ ID NO: 2401 - RNA, 21 nt, Artificial Sequence
  Synthetic polynucleotide
gggaggagguggcccuuuuuu

SEQ ID NO: 2402 - RNA, 21 nt, Artificial Sequence
  Synthetic polynucleotide
ggggaggagguggcccuuuuu

SEQ ID NO: 2403 - RNA, 21 nt, Artificial Sequence
  Synthetic polynucleotide
uggggaggagguggcccuuuu

SEQ ID NO: 2404 - RNA, 21 nt, Artificial Sequence
  Synthetic polynucleotide
cuggggaggagguggcccuuu

SEQ ID NO: 2405 - RNA, 21 nt, Artificial Sequence
  Synthetic polynucleotide
gcuggggaggagguggcccuu

SEQ ID NO: 2406 - RNA, 21 nt, Artificial Sequence
  Synthetic polynucleotide
ggcuggggaggagguggccuu

SEQ ID NO: 2407 - RNA, 21 nt, Artificial Sequence
  Synthetic polynucleotide
gggcuggggaggagguggcuu

SEQ ID NO: 2408 - RNA, 21 nt, Artificial Sequence
  Synthetic polynucleotide
ggggcuggggaggaggugguu

SEQ ID NO: 2409 - RNA, 21 nt, Artificial Sequence
  Synthetic polynucleotide
aggggcuggggaggagguguu

SEQ ID NO: 2410 - RNA, 21 nt, Artificial Sequence
  Synthetic polynucleotide
gaggggcuggggaggagguuu

SEQ ID NO: 2411 - RNA, 21 nt, Artificial Sequence
  Synthetic polynucleotide
ggaggggcuggggaggagguu

SEQ ID NO: 2412 - RNA, 21 nt, Artificial Sequence
  Synthetic polynucleotide
cagggaggagaaucguguuuu

SEQ ID NO: 2413 - RNA, 21 nt, Artificial Sequence
  Synthetic polynucleotide
aggaggggcuggggaggaguu

SEQ ID NO: 2414 - RNA, 21 nt, Artificial Sequence
  Synthetic polynucleotide
caggaggggcuggggaggauu

SEQ ID NO: 2415 - RNA, 21 nt, Artificial Sequence
  Synthetic polynucleotide
gcaggaggggcuggggagguu

SEQ ID NO: 2416 - RNA, 21 nt, Artificial Sequence
  Synthetic polynucleotide
ugcaggaggggcuggggaguu

SEQ ID NO: 2417 - RNA, 21 nt, Artificial Sequence
  Synthetic polynucleotide
cugcaggaggggcuggggauu

SEQ ID NO: 2418 - RNA, 21 nt, Artificial Sequence
  Synthetic polynucleotide
gcugcaggaggggcugggguu

SEQ ID NO: 2419 - RNA, 21 nt, Artificial Sequence
  Synthetic polynucleotide
cgcugcaggaggggcuggguu

SEQ ID NO: 2420 - RNA, 21 nt, Artificial Sequence
  Synthetic polynucleotide
acgcugcaggaggggcugguu

SEQ ID NO: 2421 - RNA, 21 nt, Artificial Sequence
  Synthetic polynucleotide
gacgcugcaggaggggcuguu

SEQ ID NO: 2422 - RNA, 21 nt, Artificial Sequence
  Synthetic polynucleotide
agacgcugcaggaggggcuuu

SEQ ID NO: 2423 - RNA, 21 nt, Artificial Sequence
  Synthetic polynucleotide
ccagggaggagaaucguguuu

SEQ ID NO: 2424 - RNA, 21 nt, Artificial Sequence
  Synthetic polynucleotide
gagacgcugcaggaggggcuu

SEQ ID NO: 2425 - RNA, 21 nt, Artificial Sequence
  Synthetic polynucleotide
agagacgcugcaggagggguu

SEQ ID NO: 2426 - RNA, 21 nt, Artificial Sequence
  Synthetic polynucleotide
cagagacgcugcaggaggguu

SEQ ID NO: 2427 - RNA, 21 nt, Artificial Sequence
  Synthetic polynucleotide
gcagagacgcugcaggagguu

SEQ ID NO: 2428 - RNA, 21 nt, Artificial Sequence
  Synthetic polynucleotide
agcagagacgcugcaggaguu

SEQ ID NO: 2429 - RNA, 21 nt, Artificial Sequence
  Synthetic polynucleotide
gagcagagacgcugcaggauu

SEQ ID NO: 2430 - RNA, 21 nt, Artificial Sequence
  Synthetic polynucleotide
ggagcagagacgcugcagguu

SEQ ID NO: 2431 - RNA, 21 nt, Artificial Sequence
  Synthetic polynucleotide
cggagcagagacgcugcaguu

SEQ ID NO: 2432 - RNA, 21 nt, Artificial Sequence
  Synthetic polynucleotide
ccggagcagagacgcugcauu

SEQ ID NO: 2433 - RNA, 21 nt, Artificial Sequence
  Synthetic polynucleotide
uccggagcagagacgcugcuu

SEQ ID NO: 2434 - RNA, 21 nt, Artificial Sequence
  Synthetic polynucleotide
cccagggaggagaaucguguu

SEQ ID NO: 2435 - RNA, 21 nt, Artificial Sequence
  Synthetic polynucleotide
guccggagcagagacgcuguu

SEQ ID NO: 2436 - RNA, 21 nt, Artificial Sequence
  Synthetic polynucleotide
gguccggagcagagacgcuuu

SEQ ID NO: 2437 - RNA, 21 nt, Artificial Sequence
  Synthetic polynucleotide
agguccggagcagagacgcuu

SEQ ID NO: 2438 - RNA, 21 nt, Artificial Sequence
  Synthetic polynucleotide
gagguccggagcagagacguu

SEQ ID NO: 2439 - RNA, 21 nt, Artificial Sequence
  Synthetic polynucleotide
cgagguccggagcagagacuu

SEQ ID NO: 2440 - RNA, 21 nt, Artificial Sequence
  Synthetic polynucleotide
gcgagguccggagcagagauu

SEQ ID NO: 2441 - RNA, 21 nt, Artificial Sequence
  Synthetic polynucleotide
ggcgagguccggagcagaguu

SEQ ID NO: 2442 - RNA, 21 nt, Artificial Sequence
  Synthetic polynucleotide
aggcgagguccggagcagauu

SEQ ID NO: 2443 - RNA, 21 nt, Artificial Sequence
  Synthetic polynucleotide
gaggcgagguccggagcaguu

SEQ ID NO: 2444 - RNA, 21 nt, Artificial Sequence
  Synthetic polynucleotide
ggaggcgagguccggagcauu

SEQ ID NO: 2445 - RNA, 21 nt, Artificial Sequence
  Synthetic polynucleotide
ccccagggaggagaaucguuu

SEQ ID NO: 2446 - RNA, 21 nt, Artificial Sequence
  Synthetic polynucleotide
aggaggcgagguccggagcuu

SEQ ID NO: 2447 - RNA, 21 nt, Artificial Sequence
  Synthetic polynucleotide
gaggaggcgagguccggaguu

SEQ ID NO: 2448 - RNA, 21 nt, Artificial Sequence
  Synthetic polynucleotide
ggaggaggcgagguccggauu

SEQ ID NO: 2449 - RNA, 21 nt, Artificial Sequence
  Synthetic polynucleotide
aggaggaggcgagguccgguu

SEQ ID NO: 2450 - RNA, 21 nt, Artificial Sequence
  Synthetic polynucleotide
caggaggaggcgagguccguu

SEQ ID NO: 2451 - RNA, 21 nt, Artificial Sequence
  Synthetic polynucleotide
gcaggaggaggcgagguccuu

SEQ ID NO: 2452 - RNA, 21 nt, Artificial Sequence
  Synthetic polynucleotide
agcaggaggaggcgaggucuu

SEQ ID NO: 2453 - RNA, 21 nt, Artificial Sequence
  Synthetic polynucleotide
gagcaggaggaggcgagguuu

SEQ ID NO: 2454 - RNA, 21 nt, Artificial Sequence
  Synthetic polynucleotide
agagcaggaggaggcgagguu

SEQ ID NO: 2455 - RNA, 21 nt, Artificial Sequence
  Synthetic polynucleotide
gagagcaggaggaggcgaguu

SEQ ID NO: 2456 - RNA, 21 nt, Artificial Sequence
  Synthetic polynucleotide
uccccagggaggagaaucguu

SEQ ID NO: 2457 - RNA, 21 nt, Artificial Sequence
  Synthetic polynucleotide
ggagagcaggaggaggcgauu

SEQ ID NO: 2458 - RNA, 21 nt, Artificial Sequence
  Synthetic polynucleotide
gggagagcaggaggaggcguu

SEQ ID NO: 2459 - RNA, 21 nt, Artificial Sequence
  Synthetic polynucleotide
agggagagcaggaggaggcuu

SEQ ID NO: 2460 - RNA, 21 nt, Artificial Sequence
  Synthetic polynucleotide
cagggagagcaggaggagguu

SEQ ID NO: 2461 - RNA, 21 nt, Artificial Sequence
  Synthetic polynucleotide
ccagggagagcaggaggaguu

SEQ ID NO: 2462 - RNA, 21 nt, Artificial Sequence
  Synthetic polynucleotide
cccagggagagcaggaggauu

SEQ ID NO: 2463 - RNA, 21 nt, Artificial Sequence
  Synthetic polynucleotide
cacucuuccgugcaccguuuu

SEQ ID NO: 2464 - RNA, 21 nt, Artificial Sequence
  Synthetic polynucleotide
gcccagggagagcaggagguu

SEQ ID NO: 2465 - RNA, 21 nt, Artificial Sequence
  Synthetic polynucleotide
ggcccagggagagcaggaguu

SEQ ID NO: 2466 - RNA, 21 nt, Artificial Sequence
  Synthetic polynucleotide
aggcccagggagagcaggauu

SEQ ID NO: 2467 - RNA, 21 nt, Artificial Sequence
  Synthetic polynucleotide
gaggcccagggagagcagguu

SEQ ID NO: 2468 - RNA, 21 nt, Artificial Sequence
  Synthetic polynucleotide
cuccccagggaggagaaucuu

SEQ ID NO: 2469 - RNA, 21 nt, Artificial Sequence
  Synthetic polynucleotide
ugaggcccagggagagcaguu

SEQ ID NO: 2470 - RNA, 21 nt, Artificial Sequence
  Synthetic polynucleotide
cugaggcccagggagagcauu

SEQ ID NO: 2471 - RNA, 21 nt, Artificial Sequence
  Synthetic polynucleotide
gcugaggcccagggagagcuu

SEQ ID NO: 2472 - RNA, 21 nt, Artificial Sequence
  Synthetic polynucleotide
ggcugaggcccagggagaguu

SEQ ID NO: 2473 - RNA, 21 nt, Artificial Sequence
  Synthetic polynucleotide
aggcugaggcccagggagauu

SEQ ID NO: 2474 - RNA, 21 nt, Artificial Sequence
  Synthetic polynucleotide
gaggcugaggcccagggaguu

SEQ ID NO: 2475 - RNA, 21 nt, Artificial Sequence
  Synthetic polynucleotide
ggaggcugaggcccagggauu

SEQ ID NO: 2476 - RNA, 21 nt, Artificial Sequence
  Synthetic polynucleotide
aggaggcugaggcccaggguu

SEQ ID NO: 2477 - RNA, 21 nt, Artificial Sequence
  Synthetic polynucleotide
caggaggcugaggcccagguu

SEQ ID NO: 2478 - RNA, 21 nt, Artificial Sequence
  Synthetic polynucleotide
gcaggaggcugaggcccaguu

SEQ ID NO: 2479 - RNA, 21 nt, Artificial Sequence
  Synthetic polynucleotide
gcuccccagggaggagaauuu

SEQ ID NO: 2480 - RNA, 21 nt, Artificial Sequence
  Synthetic polynucleotide
agcaggaggcugaggcccauu

SEQ ID NO: 2481 - RNA, 21 nt, Artificial Sequence
  Synthetic polynucleotide
cagcaggaggcugaggcccuu

SEQ ID NO: 2482 - RNA, 21 nt, Artificial Sequence
  Synthetic polynucleotide
gcagcaggaggcugaggccuu

SEQ ID NO: 2483 - RNA, 21 nt, Artificial Sequence
  Synthetic polynucleotide
agcagcaggaggcugaggcuu

SEQ ID NO: 2484 - RNA, 21 nt, Artificial Sequence
  Synthetic polynucleotide
aagcagcaggaggcugagguu

SEQ ID NO: 2485 - RNA, 21 nt, Artificial Sequence
  Synthetic polynucleotide
caagcagcaggaggcugaguu

SEQ ID NO: 2486 - RNA, 21 nt, Artificial Sequence
  Synthetic polynucleotide
acaagcagcaggaggcugauu

SEQ ID NO: 2487 - RNA, 21 nt, Artificial Sequence
  Synthetic polynucleotide
cacaagcagcaggaggcuguu

SEQ ID NO: 2488 - RNA, 21 nt, Artificial Sequence
  Synthetic polynucleotide
ccacaagcagcaggaggcuuu

SEQ ID NO: 2489 - RNA, 21 nt, Artificial Sequence
  Synthetic polynucleotide
accacaagcagcaggaggcuu

SEQ ID NO: 2490 - RNA, 21 nt, Artificial Sequence
  Synthetic polynucleotide
ugcuccccagggaggagaauu

SEQ ID NO: 2491 - RNA, 21 nt, Artificial Sequence
  Synthetic polynucleotide
aaccacaagcagcaggagguu

SEQ ID NO: 2492 - RNA, 21 nt, Artificial Sequence
  Synthetic polynucleotide
caaccacaagcagcaggaguu

SEQ ID NO: 2493 - RNA, 21 nt, Artificial Sequence
  Synthetic polynucleotide
acaaccacaagcagcaggauu

SEQ ID NO: 2494 - RNA, 21 nt, Artificial Sequence
  Synthetic polynucleotide
gacaaccacaagcagcagguu

SEQ ID NO: 2495 - RNA, 21 nt, Artificial Sequence
  Synthetic polynucleotide
agacaaccacaagcagcaguu

SEQ ID NO: 2496 - RNA, 21 nt, Artificial Sequence
  Synthetic polynucleotide
cagacaaccacaagcagcauu

SEQ ID NO: 2497 - RNA, 21 nt, Artificial Sequence
  Synthetic polynucleotide
acagacaaccacaagcagcuu

SEQ ID NO: 2498 - RNA, 21 nt, Artificial Sequence
  Synthetic polynucleotide
cacagacaaccacaagcaguu

SEQ ID NO: 2499 - RNA, 21 nt, Artificial Sequence
  Synthetic polynucleotide
acacagacaaccacaagcauu

SEQ ID NO: 2500 - RNA, 21 nt, Artificial Sequence
  Synthetic polynucleotide
cacacagacaaccacaagcuu

SEQ ID NO: 2501 - RNA, 21 nt, Artificial Sequence
  Synthetic polynucleotide
cugcuccccagggaggagauu

SEQ ID NO: 2502 - RNA, 21 nt, Artificial Sequence
  Synthetic polynucleotide
ucacacagacaaccacaaguu

SEQ ID NO: 2503 - RNA, 21 nt, Artificial Sequence
  Synthetic polynucleotide
aucacacagacaaccacaauu

SEQ ID NO: 2504 - RNA, 21 nt, Artificial Sequence
  Synthetic polynucleotide
gaucacacagacaaccacauu

SEQ ID NO: 2505 - RNA, 21 nt, Artificial Sequence
  Synthetic polynucleotide
cgaucacacagacaaccacuu

SEQ ID NO: 2506 - RNA, 21 nt, Artificial Sequence
  Synthetic polynucleotide
ccgaucacacagacaaccauu

SEQ ID NO: 2507 - RNA, 21 nt, Artificial Sequence
  Synthetic polynucleotide
uccgaucacacagacaaccuu

SEQ ID NO: 2508 - RNA, 21 nt, Artificial Sequence
  Synthetic polynucleotide
auccgaucacacagacaacuu

SEQ ID NO: 2509 - RNA, 21 nt, Artificial Sequence
  Synthetic polynucleotide
gauccgaucacacagacaauu

SEQ ID NO: 2510 - RNA, 21 nt, Artificial Sequence
  Synthetic polynucleotide
ggauccgaucacacagacauu

SEQ ID NO: 2511 - RNA, 21 nt, Artificial Sequence
  Synthetic polynucleotide
gggauccgaucacacagacuu

SEQ ID NO: 2512 - RNA, 21 nt, Artificial Sequence
  Synthetic polynucleotide
ucugcuccccagggaggaguu

SEQ ID NO: 2513 - RNA, 21 nt, Artificial Sequence
  Synthetic polynucleotide
ugggauccgaucacacagauu

SEQ ID NO: 2514 - RNA, 21 nt, Artificial Sequence
  Synthetic polynucleotide
uugggauccgaucacacaguu

SEQ ID NO: 2515 - RNA, 21 nt, Artificial Sequence
  Synthetic polynucleotide
uuugggauccgaucacacauu

SEQ ID NO: 2516 - RNA, 21 nt, Artificial Sequence
  Synthetic polynucleotide
uuuugggauccgaucacacuu

SEQ ID NO: 2517 - RNA, 21 nt, Artificial Sequence
  Synthetic polynucleotide
guuuugggauccgaucacauu

SEQ ID NO: 2518 - RNA, 21 nt, Artificial Sequence
  Synthetic polynucleotide
aguuuugggauccgaucacuu

SEQ ID NO: 2519 - RNA, 21 nt, Artificial Sequence
  Synthetic polynucleotide
gaguuuugggauccgaucauu

SEQ ID NO: 2520 - RNA, 21 nt, Artificial Sequence
  Synthetic polynucleotide
ggaguuuugggauccgaucuu

SEQ ID NO: 2521 - RNA, 21 nt, Artificial Sequence
  Synthetic polynucleotide
gggaguuuugggauccgauuu

SEQ ID NO: 2522 - RNA, 21 nt, Artificial Sequence
  Synthetic polynucleotide
ugggaguuuugggauccgauu

SEQ ID NO: 2523 - RNA, 21 nt, Artificial Sequence
  Synthetic polynucleotide
cucugcuccccagggaggauu

SEQ ID NO: 2524 - RNA, 21 nt, Artificial Sequence
  Synthetic polynucleotide
cugggaguuuugggauccguu

SEQ ID NO: 2525 - RNA, 21 nt, Artificial Sequence
  Synthetic polynucleotide
gcugggaguuuugggauccuu

SEQ ID NO: 2526 - RNA, 21 nt, Artificial Sequence
  Synthetic polynucleotide
agcugggaguuuugggaucuu

SEQ ID NO: 2527 - RNA, 21 nt, Artificial Sequence
  Synthetic polynucleotide
cagcugggaguuuugggauuu

SEQ ID NO: 2528 - RNA, 21 nt, Artificial Sequence
  Synthetic polynucleotide
gcagcugggaguuuugggauu

SEQ ID NO: 2529 - RNA, 21 nt, Artificial Sequence
  Synthetic polynucleotide
ugcagcugggaguuuuggguu

SEQ ID NO: 2530 - RNA, 21 nt, Artificial Sequence
  Synthetic polynucleotide
cugcagcugggaguuuugguu

SEQ ID NO: 2531 - RNA, 21 nt, Artificial Sequence
  Synthetic polynucleotide
ccugcagcugggaguuuuguu

SEQ ID NO: 2532 - RNA, 21 nt, Artificial Sequence
  Synthetic polynucleotide
uccugcagcugggaguuuuuu

SEQ ID NO: 2533 - RNA, 21 nt, Artificial Sequence
  Synthetic polynucleotide
cuccugcagcugggaguuuuu

SEQ ID NO: 2534 - RNA, 21 nt, Artificial Sequence
  Synthetic polynucleotide
gcucugcuccccagggagguu

SEQ ID NO: 2535 - RNA, 21 nt, Artificial Sequence
  Synthetic polynucleotide
ccuccugcagcugggaguuuu

SEQ ID NO: 2536 - RNA, 21 nt, Artificial Sequence
  Synthetic polynucleotide
uccuccugcagcugggaguuu

SEQ ID NO: 2537 - RNA, 21 nt, Artificial Sequence
  Synthetic polynucleotide
cuccuccugcagcugggaguu

SEQ ID NO: 2538 - RNA, 21 nt, Artificial Sequence
  Synthetic polynucleotide
gcuccuccugcagcugggauu

SEQ ID NO: 2539 - RNA, 21 nt, Artificial Sequence
  Synthetic polynucleotide
agcuccuccugcagcuggguu

SEQ ID NO: 2540 - RNA, 21 nt, Artificial Sequence
  Synthetic polynucleotide
cagcuccuccugcagcugguu

SEQ ID NO: 2541 - RNA, 21 nt, Artificial Sequence
  Synthetic polynucleotide
gcagcuccuccugcagcuguu

SEQ ID NO: 2542 - RNA, 21 nt, Artificial Sequence
  Synthetic polynucleotide
cgcagcuccuccugcagcuuu

SEQ ID NO: 2543 - RNA, 21 nt, Artificial Sequence
  Synthetic polynucleotide
ccgcagcuccuccugcagcuu

SEQ ID NO: 2544 - RNA, 21 nt, Artificial Sequence
  Synthetic polynucleotide
cccgcagcuccuccugcaguu

SEQ ID NO: 2545 - RNA, 21 nt, Artificial Sequence
  Synthetic polynucleotide
ccccgcagcuccuccugcauu

SEQ ID NO: 2546 - RNA, 21 nt, Artificial Sequence
  Synthetic polynucleotide
ugcucugcuccccagggaguu

SEQ ID NO: 2547 - RNA, 21 nt, Artificial Sequence
  Synthetic polynucleotide
gccccgcagcuccuccugcuu

SEQ ID NO: 2548 - RNA, 21 nt, Artificial Sequence
  Synthetic polynucleotide
ggccccgcagcuccuccuguu

SEQ ID NO: 2549 - RNA, 21 nt, Artificial Sequence
  Synthetic polynucleotide
aggccccgcagcuccuccuuu

SEQ ID NO: 2550 - RNA, 21 nt, Artificial Sequence
  Synthetic polynucleotide
caggccccgcagcuccuccuu

SEQ ID NO: 2551 - RNA, 21 nt, Artificial Sequence
  Synthetic polynucleotide
ucaggccccgcagcuccucuu

SEQ ID NO: 2552 - RNA, 21 nt, Artificial Sequence
  Synthetic polynucleotide
cucaggccccgcagcuccuuu

SEQ ID NO: 2553 - RNA, 21 nt, Artificial Sequence
  Synthetic polynucleotide
ucucaggccccgcagcuccuu

SEQ ID NO: 2554 - RNA, 21 nt, Artificial Sequence
  Synthetic polynucleotide
cucucaggccccgcagcucuu

SEQ ID NO: 2555 - RNA, 21 nt, Artificial Sequence
  Synthetic polynucleotide
ucucucaggccccgcagcuuu

SEQ ID NO: 2556 - RNA, 21 nt, Artificial Sequence
  Synthetic polynucleotide
cucucucaggccccgcagcuu

SEQ ID NO: 2557 - RNA, 21 nt, Artificial Sequence
  Synthetic polynucleotide
cugcucugcuccccagggauu

SEQ ID NO: 2558 - RNA, 21 nt, Artificial Sequence
  Synthetic polynucleotide
ucucucucaggccccgcaguu

SEQ ID NO: 2559 - RNA, 21 nt, Artificial Sequence
  Synthetic polynucleotide
gucucucucaggccccgcauu

SEQ ID NO: 2560 - RNA, 21 nt, Artificial Sequence
  Synthetic polynucleotide
cgucucucucaggccccgcuu

SEQ ID NO: 2561 - RNA, 21 nt, Artificial Sequence
  Synthetic polynucleotide
acgucucucucaggccccguu

SEQ ID NO: 2562 - RNA, 21 nt, Artificial Sequence
  Synthetic polynucleotide
aacgucucucucaggccccuu

SEQ ID NO: 2563 - RNA, 21 nt, Artificial Sequence
  Synthetic polynucleotide
gaacgucucucucaggcccuu

SEQ ID NO: 2564 - RNA, 21 nt, Artificial Sequence
  Synthetic polynucleotide
ugaacgucucucucaggccuu

SEQ ID NO: 2565 - RNA, 21 nt, Artificial Sequence
  Synthetic polynucleotide
cugaacgucucucucaggcuu

SEQ ID NO: 2566 - RNA, 21 nt, Artificial Sequence
  Synthetic polynucleotide
gcugaacgucucucucagguu

SEQ ID NO: 2567 - RNA, 21 nt, Artificial Sequence
  Synthetic polynucleotide
ugcugaacgucucucucaguu

SEQ ID NO: 2568 - RNA, 21 nt, Artificial Sequence
  Synthetic polynucleotide
ucugcucugcuccccaggguu

SEQ ID NO: 2569 - RNA, 21 nt, Artificial Sequence
  Synthetic polynucleotide
uugcugaacgucucucucauu

SEQ ID NO: 2570 - RNA, 21 nt, Artificial Sequence
  Synthetic polynucleotide
guugcugaacgucucucucuu

SEQ ID NO: 2571 - RNA, 21 nt, Artificial Sequence
  Synthetic polynucleotide
aguugcugaacgucucucuuu

SEQ ID NO: 2572 - RNA, 21 nt, Artificial Sequence
  Synthetic polynucleotide
aaguugcugaacgucucucuu

SEQ ID NO: 2573 - RNA, 21 nt, Artificial Sequence
  Synthetic polynucleotide
gaaguugcugaacgucucuuu

SEQ ID NO: 2574 - RNA, 21 nt, Artificial Sequence
  Synthetic polynucleotide
ugaaguugcugaacgucucuu

SEQ ID NO: 2575 - RNA, 21 nt, Artificial Sequence
  Synthetic polynucleotide
ucacucuuccgugcaccguuu

SEQ ID NO: 2576 - RNA, 21 nt, Artificial Sequence
  Synthetic polynucleotide
gugaaguugcugaacgucuuu

SEQ ID NO: 2577 - RNA, 21 nt, Artificial Sequence
  Synthetic polynucleotide
ugugaaguugcugaacgucuu

SEQ ID NO: 2578 - RNA, 21 nt, Artificial Sequence
  Synthetic polynucleotide
cugugaaguugcugaacguuu

SEQ ID NO: 2579 - RNA, 21 nt, Artificial Sequence
  Synthetic polynucleotide
gcugugaaguugcugaacguu

SEQ ID NO: 2580 - RNA, 21 nt, Artificial Sequence
  Synthetic polynucleotide
cucugcucugcuccccagguu

SEQ ID NO: 2581 - RNA, 21 nt, Artificial Sequence
  Synthetic polynucleotide
cgcugugaaguugcugaacuu

SEQ ID NO: 2582 - RNA, 21 nt, Artificial Sequence
  Synthetic polynucleotide
ucgcugugaaguugcugaauu

SEQ ID NO: 2583 - RNA, 21 nt, Artificial Sequence
  Synthetic polynucleotide
cucgcugugaaguugcugauu

SEQ ID NO: 2584 - RNA, 21 nt, Artificial Sequence
  Synthetic polynucleotide
gcucgcugugaaguugcuguu

SEQ ID NO: 2585 - RNA, 21 nt, Artificial Sequence
  Synthetic polynucleotide
ugcucgcugugaaguugcuuu

SEQ ID NO: 2586 - RNA, 21 nt, Artificial Sequence
  Synthetic polynucleotide
gugcucgcugugaaguugcuu

SEQ ID NO: 2587 - RNA, 21 nt, Artificial Sequence
  Synthetic polynucleotide
cgugcucgcugugaaguuguu

SEQ ID NO: 2588 - RNA, 21 nt, Artificial Sequence
  Synthetic polynucleotide
ccgugcucgcugugaaguuuu

SEQ ID NO: 2589 - RNA, 21 nt, Artificial Sequence
  Synthetic polynucleotide
uccgugcucgcugugaaguuu

SEQ ID NO: 2590 - RNA, 21 nt, Artificial Sequence
  Synthetic polynucleotide
cuccgugcucgcugugaaguu

SEQ ID NO: 2591 - RNA, 21 nt, Artificial Sequence
  Synthetic polynucleotide
ccucugcucugcuccccaguu

SEQ ID NO: 2592 - RNA, 21 nt, Artificial Sequence
  Synthetic polynucleotide
ccuccgugcucgcugugaauu

SEQ ID NO: 2593 - RNA, 21 nt, Artificial Sequence
  Synthetic polynucleotide
gccuccgugcucgcugugauu

SEQ ID NO: 2594 - RNA, 21 nt, Artificial Sequence
  Synthetic polynucleotide
ggccuccgugcucgcuguguu

SEQ ID NO: 2595 - RNA, 21 nt, Artificial Sequence
  Synthetic polynucleotide
gggccuccgugcucgcuguuu

SEQ ID NO: 2596 - RNA, 21 nt, Artificial Sequence
  Synthetic polynucleotide
ugggccuccgugcucgcuguu

SEQ ID NO: 2597 - RNA, 21 nt, Artificial Sequence
  Synthetic polynucleotide
cugggccuccgugcucgcuuu

SEQ ID NO: 2598 - RNA, 21 nt, Artificial Sequence
  Synthetic polynucleotide
ccugggccuccgugcucgcuu

SEQ ID NO: 2599 - RNA, 21 nt, Artificial Sequence
  Synthetic polynucleotide
accugggccuccgugcucguu

SEQ ID NO: 2600 - RNA, 21 nt, Artificial Sequence
  Synthetic polynucleotide
gaccugggccuccgugcucuu

SEQ ID NO: 2601 - RNA, 21 nt, Artificial Sequence
  Synthetic polynucleotide
ugaccugggccuccgugcuuu

SEQ ID NO: 2602 - RNA, 21 nt, Artificial Sequence
  Synthetic polynucleotide
gccucugcucugcuccccauu

SEQ ID NO: 2603 - RNA, 21 nt, Artificial Sequence
  Synthetic polynucleotide
uugaccugggccuccgugcuu

SEQ ID NO: 2604 - RNA, 21 nt, Artificial Sequence
  Synthetic polynucleotide
cuugaccugggccuccguguu

SEQ ID NO: 2605 - RNA, 21 nt, Artificial Sequence
  Synthetic polynucleotide
ccuugaccugggccuccguuu

SEQ ID NO: 2606 - RNA, 21 nt, Artificial Sequence
  Synthetic polynucleotide
cccuugaccugggccuccguu

SEQ ID NO: 2607 - RNA, 21 nt, Artificial Sequence
  Synthetic polynucleotide
gcccuugaccugggccuccuu

SEQ ID NO: 2608 - RNA, 21 nt, Artificial Sequence
  Synthetic polynucleotide
agcccuugaccugggccucuu

SEQ ID NO: 2609 - RNA, 21 nt, Artificial Sequence
  Synthetic polynucleotide
aagcccuugaccugggccuuu

SEQ ID NO: 2610 - RNA, 21 nt, Artificial Sequence
  Synthetic polynucleotide
caagcccuugaccugggccuu

SEQ ID NO: 2611 - RNA, 21 nt, Artificial Sequence
  Synthetic polynucleotide
ucaagcccuugaccugggcuu

SEQ ID NO: 2612 - RNA, 21 nt, Artificial Sequence
  Synthetic polynucleotide
cucaagcccuugaccuggguu

SEQ ID NO: 2613 - RNA, 21 nt, Artificial Sequence
  Synthetic polynucleotide
ugccucugcucugcuccccuu

SEQ ID NO: 2614 - RNA, 21 nt, Artificial Sequence
  Synthetic polynucleotide
gcucaagcccuugaccugguu

SEQ ID NO: 2615 - RNA, 21 nt, Artificial Sequence
  Synthetic polynucleotide
ugcucaagcccuugaccuguu

SEQ ID NO: 2616 - RNA, 21 nt, Artificial Sequence
  Synthetic polynucleotide
gugcucaagcccuugaccuuu

SEQ ID NO: 2617 - RNA, 21 nt, Artificial Sequence
  Synthetic polynucleotide
ggugcucaagcccuugaccuu

SEQ ID NO: 2618 - RNA, 21 nt, Artificial Sequence
  Synthetic polynucleotide
gggugcucaagcccuugacuu

SEQ ID NO: 2619 - RNA, 21 nt, Artificial Sequence
  Synthetic polynucleotide
ugggugcucaagcccuugauu

SEQ ID NO: 2620 - RNA, 21 nt, Artificial Sequence
  Synthetic polynucleotide
cugggugcucaagcccuuguu

SEQ ID NO: 2621 - RNA, 21 nt, Artificial Sequence
  Synthetic polynucleotide
ccugggugcucaagcccuuuu

SEQ ID NO: 2622 - RNA, 21 nt, Artificial Sequence
  Synthetic polynucleotide
cccugggugcucaagcccuuu

SEQ ID NO: 2623 - RNA, 21 nt, Artificial Sequence
  Synthetic polynucleotide
ucccugggugcucaagcccuu

SEQ ID NO: 2624 - RNA, 21 nt, Artificial Sequence
  Synthetic polynucleotide
uugccucugcucugcucccuu

SEQ ID NO: 2625 - RNA, 21 nt, Artificial Sequence
  Synthetic polynucleotide
cucccugggugcucaagccuu

SEQ ID NO: 2626 - RNA, 21 nt, Artificial Sequence
  Synthetic polynucleotide
ccucccugggugcucaagcuu

SEQ ID NO: 2627 - RNA, 21 nt, Artificial Sequence
  Synthetic polynucleotide
gccucccugggugcucaaguu

SEQ ID NO: 2628 - RNA, 21 nt, Artificial Sequence
  Synthetic polynucleotide
ugccucccugggugcucaauu

SEQ ID NO: 2629 - RNA, 21 nt, Artificial Sequence
  Synthetic polynucleotide
uugccucccugggugcucauu

SEQ ID NO: 2630 - RNA, 21 nt, Artificial Sequence
  Synthetic polynucleotide
auugccucccugggugcucuu

SEQ ID NO: 2631 - RNA, 21 nt, Artificial Sequence
  Synthetic polynucleotide
cauugccucccugggugcuuu

SEQ ID NO: 2632 - RNA, 21 nt, Artificial Sequence
  Synthetic polynucleotide
acauugccucccugggugcuu

SEQ ID NO: 2633 - RNA, 21 nt, Artificial Sequence
  Synthetic polynucleotide
cacauugccucccuggguguu

SEQ ID NO: 2634 - RNA, 21 nt, Artificial Sequence
  Synthetic polynucleotide
ccacauugccucccuggguuu

SEQ ID NO: 2635 - RNA, 21 nt, Artificial Sequence
  Synthetic polynucleotide
guugccucugcucugcuccuu

SEQ ID NO: 2636 - RNA, 21 nt, Artificial Sequence
  Synthetic polynucleotide
cccacauugccucccuggguu

SEQ ID NO: 2637 - RNA, 21 nt, Artificial Sequence
  Synthetic polynucleotide
ucccacauugccucccugguu

SEQ ID NO: 2638 - RNA, 21 nt, Artificial Sequence
  Synthetic polynucleotide
uucccacauugccucccuguu

SEQ ID NO: 2639 - RNA, 21 nt, Artificial Sequence
  Synthetic polynucleotide
cuucccacauugccucccuuu

SEQ ID NO: 2640 - RNA, 21 nt, Artificial Sequence
  Synthetic polynucleotide
ucuucccacauugccucccuu

SEQ ID NO: 2641 - RNA, 21 nt, Artificial Sequence
  Synthetic polynucleotide
uucuucccacauugccuccuu

SEQ ID NO: 2642 - RNA, 21 nt, Artificial Sequence
  Synthetic polynucleotide
uuucuucccacauugccucuu

SEQ ID NO: 2643 - RNA, 21 nt, Artificial Sequence
  Synthetic polynucleotide
cuuucuucccacauugccuuu

SEQ ID NO: 2644 - RNA, 21 nt, Artificial Sequence
  Synthetic polynucleotide
ucuuucuucccacauugccuu

SEQ ID NO: 2645 - RNA, 21 nt, Artificial Sequence
  Synthetic polynucleotide
aucuuucuucccacauugcuu

SEQ ID NO: 2646 - RNA, 21 nt, Artificial Sequence
  Synthetic polynucleotide
gguugccucugcucugcucuu

SEQ ID NO: 2647 - RNA, 21 nt, Artificial Sequence
  Synthetic polynucleotide
caucuuucuucccacauuguu

SEQ ID NO: 2648 - RNA, 21 nt, Artificial Sequence
  Synthetic polynucleotide
ucaucuuucuucccacauuuu

SEQ ID NO: 2649 - RNA, 21 nt, Artificial Sequence
  Synthetic polynucleotide
uucaucuuucuucccacauuu

SEQ ID NO: 2650 - RNA, 21 nt, Artificial Sequence
  Synthetic polynucleotide
cuucaucuuucuucccacauu

SEQ ID NO: 2651 - RNA, 21 nt, Artificial Sequence
  Synthetic polynucleotide
acuucaucuuucuucccacuu

SEQ ID NO: 2652 - RNA, 21 nt, Artificial Sequence
  Synthetic polynucleotide
gacuucaucuuucuucccauu

SEQ ID NO: 2653 - RNA, 21 nt, Artificial Sequence
  Synthetic polynucleotide
cgacuucaucuuucuucccuu

SEQ ID NO: 2654 - RNA, 21 nt, Artificial Sequence
  Synthetic polynucleotide
gcgacuucaucuuucuuccuu

SEQ ID NO: 2655 - RNA, 21 nt, Artificial Sequence
  Synthetic polynucleotide
agcgacuucaucuuucuucuu

SEQ ID NO: 2656 - RNA, 21 nt, Artificial Sequence
  Synthetic polynucleotide
uagcgacuucaucuuucuuuu

SEQ ID NO: 2657 - RNA, 21 nt, Artificial Sequence
  Synthetic polynucleotide
ggguugccucugcucugcuuu

SEQ ID NO: 2658 - RNA, 21 nt, Artificial Sequence
  Synthetic polynucleotide
cuagcgacuucaucuuucuuu

SEQ ID NO: 2659 - RNA, 21 nt, Artificial Sequence
  Synthetic polynucleotide
ucuagcgacuucaucuuucuu

SEQ ID NO: 2660 - RNA, 21 nt, Artificial Sequence
  Synthetic polynucleotide
cucuagcgacuucaucuuuuu

SEQ ID NO: 2661 - RNA, 21 nt, Artificial Sequence
  Synthetic polynucleotide
acucuagcgacuucaucuuuu

SEQ ID NO: 2662 - RNA, 21 nt, Artificial Sequence
  Synthetic polynucleotide
gacucuagcgacuucaucuuu

SEQ ID NO: 2663 - RNA, 21 nt, Artificial Sequence
  Synthetic polynucleotide
ggacucuagcgacuucaucuu

SEQ ID NO: 2664 - RNA, 21 nt, Artificial Sequence
  Synthetic polynucleotide
gggacucuagcgacuucauuu

SEQ ID NO: 2665 - RNA, 21 nt, Artificial Sequence
  Synthetic polynucleotide
ugggacucuagcgacuucauu

SEQ ID NO: 2666 - RNA, 21 nt, Artificial Sequence
  Synthetic polynucleotide
cugggacucuagcgacuucuu

SEQ ID NO: 2667 - RNA, 21 nt, Artificial Sequence
  Synthetic polynucleotide
gcugggacucuagcgacuuuu

SEQ ID NO: 2668 - RNA, 21 nt, Artificial Sequence
  Synthetic polynucleotide
agcugggacucuagcgacuuu

SEQ ID NO: 2669 - RNA, 21 nt, Artificial Sequence
  Synthetic polynucleotide
uggguugccucugcucugcuu

SEQ ID NO: 2670 - RNA, 21 nt, Artificial Sequence
  Synthetic polynucleotide
cagcugggacucuagcgacuu

SEQ ID NO: 2671 - RNA, 21 nt, Artificial Sequence
  Synthetic polynucleotide
ccagcugggacucuagcgauu

SEQ ID NO: 2672 - RNA, 21 nt, Artificial Sequence
  Synthetic polynucleotide
uccagcugggacucuagcguu

SEQ ID NO: 2673 - RNA, 21 nt, Artificial Sequence
  Synthetic polynucleotide
cuccagcugggacucuagcuu

SEQ ID NO: 2674 - RNA, 21 nt, Artificial Sequence
  Synthetic polynucleotide
ucuccagcugggacucuaguu

SEQ ID NO: 2675 - RNA, 21 nt, Artificial Sequence
  Synthetic polynucleotide
uucuccagcugggacucuauu

SEQ ID NO: 2676 - RNA, 21 nt, Artificial Sequence
  Synthetic polynucleotide
uuucuccagcugggacucuuu

SEQ ID NO: 2677 - RNA, 21 nt, Artificial Sequence
  Synthetic polynucleotide
guuucuccagcugggacucuu

SEQ ID NO: 2678 - RNA, 21 nt, Artificial Sequence
  Synthetic polynucleotide
uguuucuccagcugggacuuu

SEQ ID NO: 2679 - RNA, 21 nt, Artificial Sequence
  Synthetic polynucleotide
cuguuucuccagcugggacuu

SEQ ID NO: 2680 - RNA, 21 nt, Artificial Sequence
  Synthetic polynucleotide
auggguugccucugcucuguu

SEQ ID NO: 2681 - RNA, 21 nt, Artificial Sequence
  Synthetic polynucleotide
gcuguuucuccagcugggauu

SEQ ID NO: 2682 - RNA, 21 nt, Artificial Sequence
  Synthetic polynucleotide
ugcuguuucuccagcuggguu

SEQ ID NO: 2683 - RNA, 21 nt, Artificial Sequence
  Synthetic polynucleotide
cugcuguuucuccagcugguu

SEQ ID NO: 2684 - RNA, 21 nt, Artificial Sequence
  Synthetic polynucleotide
ucugcuguuucuccagcuguu

SEQ ID NO: 2685 - RNA, 21 nt, Artificial Sequence
  Synthetic polynucleotide
uucugcuguuucuccagcuuu

SEQ ID NO: 2686 - RNA, 21 nt, Artificial Sequence
  Synthetic polynucleotide
cuucugcuguuucuccagcuu

SEQ ID NO: 2687 - RNA, 21 nt, Artificial Sequence
  Synthetic polynucleotide
cucacucuuccgugcaccguu

SEQ ID NO: 2688 - RNA, 21 nt, Artificial Sequence
  Synthetic polynucleotide
ccuucugcuguuucuccaguu

SEQ ID NO: 2689 - RNA, 21 nt, Artificial Sequence
  Synthetic polynucleotide
uccuucugcuguuucuccauu

SEQ ID NO: 2690 - RNA, 21 nt, Artificial Sequence
  Synthetic polynucleotide
guccuucugcuguuucuccuu

SEQ ID NO: 2691 - RNA, 21 nt, Artificial Sequence
  Synthetic polynucleotide
gguccuucugcuguuucucuu

SEQ ID NO: 2692 - RNA, 21 nt, Artificial Sequence
  Synthetic polynucleotide
gauggguugccucugcucuuu

SEQ ID NO: 2693 - RNA, 21 nt, Artificial Sequence
  Synthetic polynucleotide
agguccuucugcuguuucuuu

SEQ ID NO: 2694 - RNA, 21 nt, Artificial Sequence
  Synthetic polynucleotide
cagguccuucugcuguuucuu

SEQ ID NO: 2695 - RNA, 21 nt, Artificial Sequence
  Synthetic polynucleotide
ucagguccuucugcuguuuuu

SEQ ID NO: 2696 - RNA, 21 nt, Artificial Sequence
  Synthetic polynucleotide
cucagguccuucugcuguuuu

SEQ ID NO: 2697 - RNA, 21 nt, Artificial Sequence
  Synthetic polynucleotide
acucagguccuucugcuguuu

SEQ ID NO: 2698 - RNA, 21 nt, Artificial Sequence
  Synthetic polynucleotide
cacucagguccuucugcuguu

SEQ ID NO: 2699 - RNA, 21 nt, Artificial Sequence
  Synthetic polynucleotide
ucacucagguccuucugcuuu

SEQ ID NO: 2700 - RNA, 21 nt, Artificial Sequence
  Synthetic polynucleotide
uucacucagguccuucugcuu

SEQ ID NO: 2701 - RNA, 21 nt, Artificial Sequence
  Synthetic polynucleotide
cuucacucagguccuucuguu

SEQ ID NO: 2702 - RNA, 21 nt, Artificial Sequence
  Synthetic polynucleotide
ucuucacucagguccuucuuu

SEQ ID NO: 2703 - RNA, 21 nt, Artificial Sequence
  Synthetic polynucleotide
ggauggguugccucugcucuu

SEQ ID NO: 2704 - RNA, 21 nt, Artificial Sequence
  Synthetic polynucleotide
aucuucacucagguccuucuu

SEQ ID NO: 2705 - RNA, 21 nt, Artificial Sequence
  Synthetic polynucleotide
gaucuucacucagguccuuuu

SEQ ID NO: 2706 - RNA, 21 nt, Artificial Sequence
  Synthetic polynucleotide
ugaucuucacucagguccuuu

SEQ ID NO: 2707 - RNA, 21 nt, Artificial Sequence
  Synthetic polynucleotide
gugaucuucacucagguccuu

SEQ ID NO: 2708 - RNA, 21 nt, Artificial Sequence
  Synthetic polynucleotide
agugaucuucacucaggucuu

SEQ ID NO: 2709 - RNA, 21 nt, Artificial Sequence
  Synthetic polynucleotide
gagugaucuucacucagguuu

SEQ ID NO: 2710 - RNA, 21 nt, Artificial Sequence
  Synthetic polynucleotide
ggagugaucuucacucagguu

SEQ ID NO: 2711 - RNA, 21 nt, Artificial Sequence
  Synthetic polynucleotide
uggagugaucuucacucaguu

SEQ ID NO: 2712 - RNA, 21 nt, Artificial Sequence
  Synthetic polynucleotide
cuggagugaucuucacucauu

SEQ ID NO: 2713 - RNA, 21 nt, Artificial Sequence
  Synthetic polynucleotide
gcuggagugaucuucacucuu

SEQ ID NO: 2714 - RNA, 21 nt, Artificial Sequence
  Synthetic polynucleotide
gggauggguugccucugcuuu

SEQ ID NO: 2715 - RNA, 21 nt, Artificial Sequence
  Synthetic polynucleotide
ggcuggagugaucuucacuuu

SEQ ID NO: 2716 - RNA, 21 nt, Artificial Sequence
  Synthetic polynucleotide
aggcuggagugaucuucacuu

SEQ ID NO: 2717 - RNA, 21 nt, Artificial Sequence
  Synthetic polynucleotide
caggcuggagugaucuucauu

SEQ ID NO: 2718 - RNA, 21 nt, Artificial Sequence
  Synthetic polynucleotide
gcaggcuggagugaucuucuu

SEQ ID NO: 2719 - RNA, 21 nt, Artificial Sequence
  Synthetic polynucleotide
agcaggcuggagugaucuuuu

SEQ ID NO: 2720 - RNA, 21 nt, Artificial Sequence
  Synthetic polynucleotide
cagcaggcuggagugaucuuu

SEQ ID NO: 2721 - RNA, 21 nt, Artificial Sequence
  Synthetic polynucleotide
gcagcaggcuggagugaucuu

SEQ ID NO: 2722 - RNA, 21 nt, Artificial Sequence
  Synthetic polynucleotide
agcagcaggcuggagugauuu

SEQ ID NO: 2723 - RNA, 21 nt, Artificial Sequence
  Synthetic polynucleotide
gagcagcaggcuggagugauu

SEQ ID NO: 2724 - RNA, 21 nt, Artificial Sequence
  Synthetic polynucleotide
ggagcagcaggcuggaguguu

SEQ ID NO: 2725 - RNA, 21 nt, Artificial Sequence
  Synthetic polynucleotide
ggggauggguugccucugcuu

SEQ ID NO: 2726 - RNA, 21 nt, Artificial Sequence
  Synthetic polynucleotide
uggagcagcaggcuggaguuu

SEQ ID NO: 2727 - RNA, 21 nt, Artificial Sequence
  Synthetic polynucleotide
guggagcagcaggcuggaguu

SEQ ID NO: 2728 - RNA, 21 nt, Artificial Sequence
  Synthetic polynucleotide
cguggagcagcaggcuggauu

SEQ ID NO: 2729 - RNA, 21 nt, Artificial Sequence
  Synthetic polynucleotide
acguggagcagcaggcugguu

SEQ ID NO: 2730 - RNA, 21 nt, Artificial Sequence
  Synthetic polynucleotide
cacguggagcagcaggcuguu

SEQ ID NO: 2731 - RNA, 21 nt, Artificial Sequence
  Synthetic polynucleotide
ucacguggagcagcaggcuuu

SEQ ID NO: 2732 - RNA, 21 nt, Artificial Sequence
  Synthetic polynucleotide
uucacguggagcagcaggcuu

SEQ ID NO: 2733 - RNA, 21 nt, Artificial Sequence
  Synthetic polynucleotide
cuucacguggagcagcagguu

SEQ ID NO: 2734 - RNA, 21 nt, Artificial Sequence
  Synthetic polynucleotide
gcuucacguggagcagcaguu

SEQ ID NO: 2735 - RNA, 21 nt, Artificial Sequence
  Synthetic polynucleotide
ugcuucacguggagcagcauu

SEQ ID NO: 2736 - RNA, 21 nt, Artificial Sequence
  Synthetic polynucleotide
gggggauggguugccucuguu

SEQ ID NO: 2737 - RNA, 21 nt, Artificial Sequence
  Synthetic polynucleotide
cugcuucacguggagcagcuu

SEQ ID NO: 2738 - RNA, 21 nt, Artificial Sequence
  Synthetic polynucleotide
acugcuucacguggagcaguu

SEQ ID NO: 2739 - RNA, 21 nt, Artificial Sequence
  Synthetic polynucleotide
aacugcuucacguggagcauu

SEQ ID NO: 2740 - RNA, 21 nt, Artificial Sequence
  Synthetic polynucleotide
gaacugcuucacguggagcuu

SEQ ID NO: 2741 - RNA, 21 nt, Artificial Sequence
  Synthetic polynucleotide
cgaacugcuucacguggaguu

SEQ ID NO: 2742 - RNA, 21 nt, Artificial Sequence
  Synthetic polynucleotide
acgaacugcuucacguggauu

SEQ ID NO: 2743 - RNA, 21 nt, Artificial Sequence
  Synthetic polynucleotide
cacgaacugcuucacgugguu

SEQ ID NO: 2744 - RNA, 21 nt, Artificial Sequence
  Synthetic polynucleotide
acacgaacugcuucacguguu

SEQ ID NO: 2745 - RNA, 21 nt, Artificial Sequence
  Synthetic polynucleotide
gacacgaacugcuucacguuu

SEQ ID NO: 2746 - RNA, 21 nt, Artificial Sequence
  Synthetic polynucleotide
agacacgaacugcuucacguu

SEQ ID NO: 2747 - RNA, 21 nt, Artificial Sequence
  Synthetic polynucleotide
ugggggauggguugccucuuu

SEQ ID NO: 2748 - RNA, 21 nt, Artificial Sequence
  Synthetic polynucleotide
cagacacgaacugcuucacuu

SEQ ID NO: 2749 - RNA, 21 nt, Artificial Sequence
  Synthetic polynucleotide
ucagacacgaacugcuucauu

SEQ ID NO: 2750 - RNA, 21 nt, Artificial Sequence
  Synthetic polynucleotide
gucagacacgaacugcuucuu

SEQ ID NO: 2751 - RNA, 21 nt, Artificial Sequence
  Synthetic polynucleotide
ggucagacacgaacugcuuuu

SEQ ID NO: 2752 - RNA, 21 nt, Artificial Sequence
  Synthetic polynucleotide
aggucagacacgaacugcuuu

SEQ ID NO: 2753 - RNA, 21 nt, Artificial Sequence
  Synthetic polynucleotide
caggucagacacgaacugcuu

SEQ ID NO: 2754 - RNA, 21 nt, Artificial Sequence
  Synthetic polynucleotide
gcaggucagacacgaacuguu

SEQ ID NO: 2755 - RNA, 21 nt, Artificial Sequence
  Synthetic polynucleotide
cgcaggucagacacgaacuuu

SEQ ID NO: 2756 - RNA, 21 nt, Artificial Sequence
  Synthetic polynucleotide
ccgcaggucagacacgaacuu

SEQ ID NO: 2757 - RNA, 21 nt, Artificial Sequence
  Synthetic polynucleotide
uccgcaggucagacacgaauu

SEQ ID NO: 2758 - RNA, 21 nt, Artificial Sequence
  Synthetic polynucleotide
gugggggauggguugccucuu

SEQ ID NO: 2759 - RNA, 21 nt, Artificial Sequence
  Synthetic polynucleotide
cuccgcaggucagacacgauu

SEQ ID NO: 2760 - RNA, 21 nt, Artificial Sequence
  Synthetic polynucleotide
gcuccgcaggucagacacguu

SEQ ID NO: 2761 - RNA, 21 nt, Artificial Sequence
  Synthetic polynucleotide
ggcuccgcaggucagacacuu

SEQ ID NO: 2762 - RNA, 21 nt, Artificial Sequence
  Synthetic polynucleotide
aggcuccgcaggucagacauu

SEQ ID NO: 2763 - RNA, 21 nt, Artificial Sequence
  Synthetic polynucleotide
caggcuccgcaggucagacuu

SEQ ID NO: 2764 - RNA, 21 nt, Artificial Sequence
  Synthetic polynucleotide
ucaggcuccgcaggucagauu

SEQ ID NO: 2765 - RNA, 21 nt, Artificial Sequence
  Synthetic polynucleotide
cucaggcuccgcaggucaguu

SEQ ID NO: 2766 - RNA, 21 nt, Artificial Sequence
  Synthetic polynucleotide
gcucaggcuccgcaggucauu

SEQ ID NO: 2767 - RNA, 21 nt, Artificial Sequence
  Synthetic polynucleotide
agcucaggcuccgcaggucuu

SEQ ID NO: 2768 - RNA, 21 nt, Artificial Sequence
  Synthetic polynucleotide
cagcucaggcuccgcagguuu

SEQ ID NO: 2769 - RNA, 21 nt, Artificial Sequence
  Synthetic polynucleotide
agugggggauggguugccuuu

SEQ ID NO: 2770 - RNA, 21 nt, Artificial Sequence
  Synthetic polynucleotide
acagcucaggcuccgcagguu

SEQ ID NO: 2771 - RNA, 21 nt, Artificial Sequence
  Synthetic polynucleotide
gacagcucaggcuccgcaguu

SEQ ID NO: 2772 - RNA, 21 nt, Artificial Sequence
  Synthetic polynucleotide
ugacagcucaggcuccgcauu

SEQ ID NO: 2773 - RNA, 21 nt, Artificial Sequence
  Synthetic polynucleotide
cugacagcucaggcuccgcuu

SEQ ID NO: 2774 - RNA, 21 nt, Artificial Sequence
  Synthetic polynucleotide
ucugacagcucaggcuccguu

SEQ ID NO: 2775 - RNA, 21 nt, Artificial Sequence
  Synthetic polynucleotide
aucugacagcucaggcuccuu

SEQ ID NO: 2776 - RNA, 21 nt, Artificial Sequence
  Synthetic polynucleotide
caucugacagcucaggcucuu

SEQ ID NO: 2777 - RNA, 21 nt, Artificial Sequence
  Synthetic polynucleotide
ccaucugacagcucaggcuuu

SEQ ID NO: 2778 - RNA, 21 nt, Artificial Sequence
  Synthetic polynucleotide
gccaucugacagcucaggcuu

SEQ ID NO: 2779 - RNA, 21 nt, Artificial Sequence
  Synthetic polynucleotide
cgccaucugacagcucagguu

SEQ ID NO: 2780 - RNA, 21 nt, Artificial Sequence
  Synthetic polynucleotide
gagugggggauggguugccuu

SEQ ID NO: 2781 - RNA, 21 nt, Artificial Sequence
  Synthetic polynucleotide
ccgccaucugacagcucaguu

SEQ ID NO: 2782 - RNA, 21 nt, Artificial Sequence
  Synthetic polynucleotide
gccgccaucugacagcucauu

SEQ ID NO: 2783 - RNA, 21 nt, Artificial Sequence
  Synthetic polynucleotide
cgccgccaucugacagcucuu

SEQ ID NO: 2784 - RNA, 21 nt, Artificial Sequence
  Synthetic polynucleotide
gcgccgccaucugacagcuuu

SEQ ID NO: 2785 - RNA, 21 nt, Artificial Sequence
  Synthetic polynucleotide
agcgccgccaucugacagcuu

SEQ ID NO: 2786 - RNA, 21 nt, Artificial Sequence
  Synthetic polynucleotide
gagcgccgccaucugacaguu

SEQ ID NO: 2787 - RNA, 21 nt, Artificial Sequence
  Synthetic polynucleotide
ggagcgccgccaucugacauu

SEQ ID NO: 2788 - RNA, 21 nt, Artificial Sequence
  Synthetic polynucleotide
uggagcgccgccaucugacuu

SEQ ID NO: 2789 - RNA, 21 nt, Artificial Sequence
  Synthetic polynucleotide
cuggagcgccgccaucugauu

SEQ ID NO: 2790 - RNA, 21 nt, Artificial Sequence
  Synthetic polynucleotide
ccuggagcgccgccaucuguu

SEQ ID NO: 2791 - RNA, 21 nt, Artificial Sequence
  Synthetic polynucleotide
cccuggagcgccgccaucuuu

SEQ ID NO: 2792 - RNA, 21 nt, Artificial Sequence
  Synthetic polynucleotide
ggagugggggauggguugcuu

SEQ ID NO: 2793 - RNA, 21 nt, Artificial Sequence
  Synthetic polynucleotide
gcccuggagcgccgccaucuu

SEQ ID NO: 2794 - RNA, 21 nt, Artificial Sequence
  Synthetic polynucleotide
gggagugggggauggguuguu

SEQ ID NO: 2795 - RNA, 21 nt, Artificial Sequence
  Synthetic polynucleotide
ugcccuggagcgccgccauuu

SEQ ID NO: 2796 - RNA, 21 nt, Artificial Sequence
  Synthetic polynucleotide
uugcccuggagcgccgccauu

SEQ ID NO: 2797 - RNA, 21 nt, Artificial Sequence
  Synthetic polynucleotide
auugcccuggagcgccgccuu

SEQ ID NO: 2798 - RNA, 21 nt, Artificial Sequence
  Synthetic polynucleotide
cauugcccuggagcgccgcuu

SEQ ID NO: 2799 - RNA, 21 nt, Artificial Sequence
  Synthetic polynucleotide
ccauugcccuggagcgccguu

SEQ ID NO: 2800 - RNA, 21 nt, Artificial Sequence
  Synthetic polynucleotide
ccucacucuuccgugcaccuu

SEQ ID NO: 2801 - RNA, 21 nt, Artificial Sequence
  Synthetic polynucleotide
gccauugcccuggagcgccuu

SEQ ID NO: 2802 - RNA, 21 nt, Artificial Sequence
  Synthetic polynucleotide
agccauugcccuggagcgcuu

SEQ ID NO: 2803 - RNA, 21 nt, Artificial Sequence
  Synthetic polynucleotide
gagccauugcccuggagcguu

SEQ ID NO: 2804 - RNA, 21 nt, Artificial Sequence
  Synthetic polynucleotide
ugagccauugcccuggagcuu

SEQ ID NO: 2805 - RNA, 21 nt, Artificial Sequence
  Synthetic polynucleotide
cugagccauugcccuggaguu

SEQ ID NO: 2806 - RNA, 21 nt, Artificial Sequence
  Synthetic polynucleotide
ugggagugggggauggguuuu

SEQ ID NO: 2807 - RNA, 21 nt, Artificial Sequence
  Synthetic polynucleotide
ucugagccauugcccuggauu

SEQ ID NO: 2808 - RNA, 21 nt, Artificial Sequence
  Synthetic polynucleotide
uucugagccauugcccugguu

SEQ ID NO: 2809 - RNA, 21 nt, Artificial Sequence
  Synthetic polynucleotide
uuucugagccauugcccuguu

SEQ ID NO: 2810 - RNA, 21 nt, Artificial Sequence
  Synthetic polynucleotide
cuuucugagccauugcccuuu

SEQ ID NO: 2811 - RNA, 21 nt, Artificial Sequence
  Synthetic polynucleotide
ccuuucugagccauugcccuu

SEQ ID NO: 2812 - RNA, 21 nt, Artificial Sequence
  Synthetic polynucleotide
uccuuucugagccauugccuu

SEQ ID NO: 2813 - RNA, 21 nt, Artificial Sequence
  Synthetic polynucleotide
guccuuucugagccauugcuu

SEQ ID NO: 2814 - RNA, 21 nt, Artificial Sequence
  Synthetic polynucleotide
gguccuuucugagccauuguu

SEQ ID NO: 2815 - RNA, 21 nt, Artificial Sequence
  Synthetic polynucleotide
agguccuuucugagccauuuu

SEQ ID NO: 2816 - RNA, 21 nt, Artificial Sequence
  Synthetic polynucleotide
cagguccuuucugagccauuu

SEQ ID NO: 2817 - RNA, 21 nt, Artificial Sequence
  Synthetic polynucleotide
gugggagugggggauggguuu

SEQ ID NO: 2818 - RNA, 21 nt, Artificial Sequence
  Synthetic polynucleotide
gcagguccuuucugagccauu

SEQ ID NO: 2819 - RNA, 21 nt, Artificial Sequence
  Synthetic polynucleotide
agcagguccuuucugagccuu

SEQ ID NO: 2820 - RNA, 21 nt, Artificial Sequence
  Synthetic polynucleotide
cagcagguccuuucugagcuu

SEQ ID NO: 2821 - RNA, 21 nt, Artificial Sequence
  Synthetic polynucleotide
gcagcagguccuuucugaguu

SEQ ID NO: 2822 - RNA, 21 nt, Artificial Sequence
  Synthetic polynucleotide
ggcagcagguccuuucugauu

SEQ ID NO: 2823 - RNA, 21 nt, Artificial Sequence
  Synthetic polynucleotide
gggcagcagguccuuucuguu

SEQ ID NO: 2824 - RNA, 21 nt, Artificial Sequence
  Synthetic polynucleotide
cgggcagcagguccuuucuuu

SEQ ID NO: 2825 - RNA, 21 nt, Artificial Sequence
  Synthetic polynucleotide
ccgggcagcagguccuuucuu

SEQ ID NO: 2826 - RNA, 21 nt, Artificial Sequence
  Synthetic polynucleotide
accgggcagcagguccuuuuu

SEQ ID NO: 2827 - RNA, 21 nt, Artificial Sequence
  Synthetic polynucleotide
gaccgggcagcagguccuuuu

SEQ ID NO: 2828 - RNA, 21 nt, Artificial Sequence
  Synthetic polynucleotide
ggugggagugggggauggguu

SEQ ID NO: 2829 - RNA, 21 nt, Artificial Sequence
  Synthetic polynucleotide
ugaccgggcagcagguccuuu

SEQ ID NO: 2830 - RNA, 21 nt, Artificial Sequence
  Synthetic polynucleotide
uugaccgggcagcagguccuu

SEQ ID NO: 2831 - RNA, 21 nt, Artificial Sequence
  Synthetic polynucleotide
guugaccgggcagcaggucuu

SEQ ID NO: 2832 - RNA, 21 nt, Artificial Sequence
  Synthetic polynucleotide
aguugaccgggcagcagguuu

SEQ ID NO: 2833 - RNA, 21 nt, Artificial Sequence
  Synthetic polynucleotide
caguugaccgggcagcagguu

SEQ ID NO: 2834 - RNA, 21 nt, Artificial Sequence
  Synthetic polynucleotide
ccaguugaccgggcagcaguu

SEQ ID NO: 2835 - RNA, 21 nt, Artificial Sequence
  Synthetic polynucleotide
cccaguugaccgggcagcauu

SEQ ID NO: 2836 - RNA, 21 nt, Artificial Sequence
  Synthetic polynucleotide
acccaguugaccgggcagcuu

SEQ ID NO: 2837 - RNA, 21 nt, Artificial Sequence
  Synthetic polynucleotide
cacccaguugaccgggcaguu

SEQ ID NO: 2838 - RNA, 21 nt, Artificial Sequence
  Synthetic polynucleotide
ccacccaguugaccgggcauu

SEQ ID NO: 2839 - RNA, 21 nt, Artificial Sequence
  Synthetic polynucleotide
gggugggagugggggaugguu

SEQ ID NO: 2840 - RNA, 21 nt, Artificial Sequence
  Synthetic polynucleotide
uccacccaguugaccgggcuu

SEQ ID NO: 2841 - RNA, 21 nt, Artificial Sequence
  Synthetic polynucleotide
cuccacccaguugaccggguu

SEQ ID NO: 2842 - RNA, 21 nt, Artificial Sequence
  Synthetic polynucleotide
gcuccacccaguugaccgguu

SEQ ID NO: 2843 - RNA, 21 nt, Artificial Sequence
  Synthetic polynucleotide
ugcuccacccaguugaccguu

SEQ ID NO: 2844 - RNA, 21 nt, Artificial Sequence
  Synthetic polynucleotide
gugcuccacccaguugaccuu

SEQ ID NO: 2845 - RNA, 21 nt, Artificial Sequence
  Synthetic polynucleotide
cgugcuccacccaguugacuu

SEQ ID NO: 2846 - RNA, 21 nt, Artificial Sequence
  Synthetic polynucleotide
ucgugcuccacccaguugauu

SEQ ID NO: 2847 - RNA, 21 nt, Artificial Sequence
  Synthetic polynucleotide
cucgugcuccacccaguuguu

SEQ ID NO: 2848 - RNA, 21 nt, Artificial Sequence
  Synthetic polynucleotide
gcucgugcuccacccaguuuu

SEQ ID NO: 2849 - RNA, 21 nt, Artificial Sequence
  Synthetic polynucleotide
cgcucgugcuccacccaguuu

SEQ ID NO: 2850 - RNA, 21 nt, Artificial Sequence
  Synthetic polynucleotide
ggggugggagugggggauguu

SEQ ID NO: 2851 - RNA, 21 nt, Artificial Sequence
  Synthetic polynucleotide
gcgcucgugcuccacccaguu

SEQ ID NO: 2852 - RNA, 21 nt, Artificial Sequence
  Synthetic polynucleotide
ugcgcucgugcuccacccauu

SEQ ID NO: 2853 - RNA, 21 nt, Artificial Sequence
  Synthetic polynucleotide
cugcgcucgugcuccacccuu

SEQ ID NO: 2854 - RNA, 21 nt, Artificial Sequence
  Synthetic polynucleotide
gcugcgcucgugcuccaccuu

SEQ ID NO: 2855 - RNA, 21 nt, Artificial Sequence
  Synthetic polynucleotide
agcugcgcucgugcuccacuu

SEQ ID NO: 2856 - RNA, 21 nt, Artificial Sequence
  Synthetic polynucleotide
cagcugcgcucgugcuccauu

SEQ ID NO: 2857 - RNA, 21 nt, Artificial Sequence
  Synthetic polynucleotide
gcagcugcgcucgugcuccuu

SEQ ID NO: 2858 - RNA, 21 nt, Artificial Sequence
  Synthetic polynucleotide
agcagcugcgcucgugcucuu

SEQ ID NO: 2859 - RNA, 21 nt, Artificial Sequence
  Synthetic polynucleotide
uagcagcugcgcucgugcuuu

SEQ ID NO: 2860 - RNA, 21 nt, Artificial Sequence
  Synthetic polynucleotide
guagcagcugcgcucgugcuu

SEQ ID NO: 2861 - RNA, 21 nt, Artificial Sequence
  Synthetic polynucleotide
gggggugggagugggggauuu

SEQ ID NO: 2862 - RNA, 21 nt, Artificial Sequence
  Synthetic polynucleotide
aguagcagcugcgcucguguu

SEQ ID NO: 2863 - RNA, 21 nt, Artificial Sequence
  Synthetic polynucleotide
caguagcagcugcgcucguuu

SEQ ID NO: 2864 - RNA, 21 nt, Artificial Sequence
  Synthetic polynucleotide
ccaguagcagcugcgcucguu

SEQ ID NO: 2865 - RNA, 21 nt, Artificial Sequence
  Synthetic polynucleotide
accaguagcagcugcgcucuu

SEQ ID NO: 2866 - RNA, 21 nt, Artificial Sequence
  Synthetic polynucleotide
aaccaguagcagcugcgcuuu

SEQ ID NO: 2867 - RNA, 21 nt, Artificial Sequence
  Synthetic polynucleotide
gaaccaguagcagcugcgcuu

SEQ ID NO: 2868 - RNA, 21 nt, Artificial Sequence
  Synthetic polynucleotide
agaaccaguagcagcugcguu

SEQ ID NO: 2869 - RNA, 21 nt, Artificial Sequence
  Synthetic polynucleotide
gagaaccaguagcagcugcuu

SEQ ID NO: 2870 - RNA, 21 nt, Artificial Sequence
  Synthetic polynucleotide
agagaaccaguagcagcuguu

SEQ ID NO: 2871 - RNA, 21 nt, Artificial Sequence
  Synthetic polynucleotide
gagagaaccaguagcagcuuu

SEQ ID NO: 2872 - RNA, 21 nt, Artificial Sequence
  Synthetic polynucleotide
ugggggugggagugggggauu

SEQ ID NO: 2873 - RNA, 21 nt, Artificial Sequence
  Synthetic polynucleotide
cgagagaaccaguagcagcuu

SEQ ID NO: 2874 - RNA, 21 nt, Artificial Sequence
  Synthetic polynucleotide
gcgagagaaccaguagcaguu

SEQ ID NO: 2875 - RNA, 21 nt, Artificial Sequence
  Synthetic polynucleotide
agcgagagaaccaguagcauu

SEQ ID NO: 2876 - RNA, 21 nt, Artificial Sequence
  Synthetic polynucleotide
gagcgagagaaccaguagcuu

SEQ ID NO: 2877 - RNA, 21 nt, Artificial Sequence
  Synthetic polynucleotide
ggagcgagagaaccaguaguu

SEQ ID NO: 2878 - RNA, 21 nt, Artificial Sequence
  Synthetic polynucleotide
cggagcgagagaaccaguauu

SEQ ID NO: 2879 - RNA, 21 nt, Artificial Sequence
  Synthetic polynucleotide
ccggagcgagagaaccaguuu

SEQ ID NO: 2880 - RNA, 21 nt, Artificial Sequence
  Synthetic polynucleotide
cccggagcgagagaaccaguu

SEQ ID NO: 2881 - RNA, 21 nt, Artificial Sequence
  Synthetic polynucleotide
ucccggagcgagagaaccauu

SEQ ID NO: 2882 - RNA, 21 nt, Artificial Sequence
  Synthetic polynucleotide
uucccggagcgagagaaccuu

SEQ ID NO: 2883 - RNA, 21 nt, Artificial Sequence
  Synthetic polynucleotide
gugggggugggaguggggguu

SEQ ID NO: 2884 - RNA, 21 nt, Artificial Sequence
  Synthetic polynucleotide
cuucccggagcgagagaacuu

SEQ ID NO: 2885 - RNA, 21 nt, Artificial Sequence
  Synthetic polynucleotide
ccuucccggagcgagagaauu

SEQ ID NO: 2886 - RNA, 21 nt, Artificial Sequence
  Synthetic polynucleotide
gccuucccggagcgagagauu

SEQ ID NO: 2887 - RNA, 21 nt, Artificial Sequence
  Synthetic polynucleotide
ggccuucccggagcgagaguu

SEQ ID NO: 2888 - RNA, 21 nt, Artificial Sequence
  Synthetic polynucleotide
aggccuucccggagcgagauu

SEQ ID NO: 2889 - RNA, 21 nt, Artificial Sequence
  Synthetic polynucleotide
caggccuucccggagcgaguu

SEQ ID NO: 2890 - RNA, 21 nt, Artificial Sequence
  Synthetic polynucleotide
ccaggccuucccggagcgauu

SEQ ID NO: 2891 - RNA, 21 nt, Artificial Sequence
  Synthetic polynucleotide
cccaggccuucccggagcguu

SEQ ID NO: 2892 - RNA, 21 nt, Artificial Sequence
  Synthetic polynucleotide
gcccaggccuucccggagcuu

SEQ ID NO: 2893 - RNA, 21 nt, Artificial Sequence
  Synthetic polynucleotide
agcccaggccuucccggaguu

SEQ ID NO: 2894 - RNA, 21 nt, Artificial Sequence
  Synthetic polynucleotide
ugugggggugggagugggguu

SEQ ID NO: 2895 - RNA, 21 nt, Artificial Sequence
  Synthetic polynucleotide
cagcccaggccuucccggauu

SEQ ID NO: 2896 - RNA, 21 nt, Artificial Sequence
  Synthetic polynucleotide
ucagcccaggccuucccgguu

SEQ ID NO: 2897 - RNA, 21 nt, Artificial Sequence
  Synthetic polynucleotide
gucagcccaggccuucccguu

SEQ ID NO: 2898 - RNA, 21 nt, Artificial Sequence
  Synthetic polynucleotide
cgucagcccaggccuucccuu

SEQ ID NO: 2899 - RNA, 21 nt, Artificial Sequence
  Synthetic polynucleotide
gcgucagcccaggccuuccuu

SEQ ID NO: 2900 - RNA, 21 nt, Artificial Sequence
  Synthetic polynucleotide
ggcgucagcccaggccuucuu

SEQ ID NO: 2901 - RNA, 21 nt, Artificial Sequence
  Synthetic polynucleotide
cggcgucagcccaggccuuuu

SEQ ID NO: 2902 - RNA, 21 nt, Artificial Sequence
  Synthetic polynucleotide
ucggcgucagcccaggccuuu

SEQ ID NO: 2903 - RNA, 21 nt, Artificial Sequence
  Synthetic polynucleotide
gucggcgucagcccaggccuu

SEQ ID NO: 2904 - RNA, 21 nt, Artificial Sequence
  Synthetic polynucleotide
ugucggcgucagcccaggcuu

SEQ ID NO: 2905 - RNA, 21 nt, Artificial Sequence
  Synthetic polynucleotide
gugugggggugggaguggguu

SEQ ID NO: 2906 - RNA, 21 nt, Artificial Sequence
  Synthetic polynucleotide
uugucggcgucagcccagguu

SEQ ID NO: 2907 - RNA, 21 nt, Artificial Sequence
  Synthetic polynucleotide
guugucggcgucagcccaguu

SEQ ID NO: 2908 - RNA, 21 nt, Artificial Sequence
  Synthetic polynucleotide
aguugucggcgucagcccauu

SEQ ID NO: 2909 - RNA, 21 nt, Artificial Sequence
  Synthetic polynucleotide
uaguugucggcgucagcccuu

SEQ ID NO: 2910 - RNA, 21 nt, Artificial Sequence
  Synthetic polynucleotide
guaguugucggcgucagccuu

SEQ ID NO: 2911 - RNA, 21 nt, Artificial Sequence
  Synthetic polynucleotide
aguaguugucggcgucagcuu

SEQ ID NO: 2912 - RNA, 21 nt, Artificial Sequence
  Synthetic polynucleotide
accucacucuuccgugcacuu

SEQ ID NO: 2913 - RNA, 21 nt, Artificial Sequence
  Synthetic polynucleotide
caguaguugucggcgucaguu

SEQ ID NO: 2914 - RNA, 21 nt, Artificial Sequence
  Synthetic polynucleotide
gcaguaguugucggcgucauu

SEQ ID NO: 2915 - RNA, 21 nt, Artificial Sequence
  Synthetic polynucleotide
ggcaguaguugucggcgucuu

SEQ ID NO: 2916 - RNA, 21 nt, Artificial Sequence
  Synthetic polynucleotide
cggcaguaguugucggcguuu

SEQ ID NO: 2917 - RNA, 21 nt, Artificial Sequence
  Synthetic polynucleotide
agugugggggugggagugguu

SEQ ID NO: 2918 - RNA, 21 nt, Artificial Sequence
  Synthetic polynucleotide
ccggcaguaguugucggcguu

SEQ ID NO: 2919 - RNA, 21 nt, Artificial Sequence
  Synthetic polynucleotide
gccggcaguaguugucggcuu

SEQ ID NO: 2920 - RNA, 21 nt, Artificial Sequence
  Synthetic polynucleotide
agccggcaguaguugucgguu

SEQ ID NO: 2921 - RNA, 21 nt, Artificial Sequence
  Synthetic polynucleotide
cagccggcaguaguugucguu

SEQ ID NO: 2922 - RNA, 21 nt, Artificial Sequence
  Synthetic polynucleotide
ccagccggcaguaguugucuu

SEQ ID NO: 2923 - RNA, 21 nt, Artificial Sequence
  Synthetic polynucleotide
uccagccggcaguaguuguuu

SEQ ID NO: 2924 - RNA, 21 nt, Artificial Sequence
  Synthetic polynucleotide
cuccagccggcaguaguuguu

SEQ ID NO: 2925 - RNA, 21 nt, Artificial Sequence
  Synthetic polynucleotide
ccuccagccggcaguaguuuu

SEQ ID NO: 2926 - RNA, 21 nt, Artificial Sequence
  Synthetic polynucleotide
uccuccagccggcaguaguuu

SEQ ID NO: 2927 - RNA, 21 nt, Artificial Sequence
  Synthetic polynucleotide
guccuccagccggcaguaguu

SEQ ID NO: 2928 - RNA, 21 nt, Artificial Sequence
  Synthetic polynucleotide
gagugugggggugggaguguu

SEQ ID NO: 2929 - RNA, 21 nt, Artificial Sequence
  Synthetic polynucleotide
cguccuccagccggcaguauu

SEQ ID NO: 2930 - RNA, 21 nt, Artificial Sequence
  Synthetic polynucleotide
gcguccuccagccggcaguuu

SEQ ID NO: 2931 - RNA, 21 nt, Artificial Sequence
  Synthetic polynucleotide
cgcguccuccagccggcaguu

SEQ ID NO: 2932 - RNA, 21 nt, Artificial Sequence
  Synthetic polynucleotide
gcgcguccuccagccggcauu

SEQ ID NO: 2933 - RNA, 21 nt, Artificial Sequence
  Synthetic polynucleotide
ugcgcguccuccagccggcuu

SEQ ID NO: 2934 - RNA, 21 nt, Artificial Sequence
  Synthetic polynucleotide
gugcgcguccuccagccgguu

SEQ ID NO: 2935 - RNA, 21 nt, Artificial Sequence
  Synthetic polynucleotide
ggugcgcguccuccagccguu

SEQ ID NO: 2936 - RNA, 21 nt, Artificial Sequence
  Synthetic polynucleotide
aggugcgcguccuccagccuu

SEQ ID NO: 2937 - RNA, 21 nt, Artificial Sequence
  Synthetic polynucleotide
caggugcgcguccuccagcuu

SEQ ID NO: 2938 - RNA, 21 nt, Artificial Sequence
  Synthetic polynucleotide
ccaggugcgcguccuccaguu

SEQ ID NO: 2939 - RNA, 21 nt, Artificial Sequence
  Synthetic polynucleotide
ggagugugggggugggaguuu

SEQ ID NO: 2940 - RNA, 21 nt, Artificial Sequence
  Synthetic polynucleotide
accaggugcgcguccuccauu

SEQ ID NO: 2941 - RNA, 21 nt, Artificial Sequence
  Synthetic polynucleotide
caccaggugcgcguccuccuu

SEQ ID NO: 2942 - RNA, 21 nt, Artificial Sequence
  Synthetic polynucleotide
ccaccaggugcgcguccucuu

SEQ ID NO: 2943 - RNA, 21 nt, Artificial Sequence
  Synthetic polynucleotide
accaccaggugcgcguccuuu

SEQ ID NO: 2944 - RNA, 21 nt, Artificial Sequence
  Synthetic polynucleotide
caccaccaggugcgcguccuu

SEQ ID NO: 2945 - RNA, 21 nt, Artificial Sequence
  Synthetic polynucleotide
ccaccaccaggugcgcgucuu

SEQ ID NO: 2946 - RNA, 21 nt, Artificial Sequence
  Synthetic polynucleotide
accaccaccaggugcgcguuu

SEQ ID NO: 2947 - RNA, 21 nt, Artificial Sequence
  Synthetic polynucleotide
gaccaccaccaggugcgcguu

SEQ ID NO: 2948 - RNA, 21 nt, Artificial Sequence
  Synthetic polynucleotide
ugaccaccaccaggugcgcuu

SEQ ID NO: 2949 - RNA, 21 nt, Artificial Sequence
  Synthetic polynucleotide
gugaccaccaccaggugcguu

SEQ ID NO: 2950 - RNA, 21 nt, Artificial Sequence
  Synthetic polynucleotide
gggagugugggggugggaguu

SEQ ID NO: 2951 - RNA, 21 nt, Artificial Sequence
  Synthetic polynucleotide
cgugaccaccaccaggugcuu

SEQ ID NO: 2952 - RNA, 21 nt, Artificial Sequence
  Synthetic polynucleotide
acgugaccaccaccagguguu

SEQ ID NO: 2953 - RNA, 21 nt, Artificial Sequence
  Synthetic polynucleotide
gacgugaccaccaccagguuu

SEQ ID NO: 2954 - RNA, 21 nt, Artificial Sequence
  Synthetic polynucleotide
ggacgugaccaccaccagguu

SEQ ID NO: 2955 - RNA, 21 nt, Artificial Sequence
  Synthetic polynucleotide
aggacgugaccaccaccaguu

SEQ ID NO: 2956 - RNA, 21 nt, Artificial Sequence
  Synthetic polynucleotide
caggacgugaccaccaccauu

SEQ ID NO: 2957 - RNA, 21 nt, Artificial Sequence
  Synthetic polynucleotide
ccaggacgugaccaccaccuu

SEQ ID NO: 2958 - RNA, 21 nt, Artificial Sequence
  Synthetic polynucleotide
cccaggacgugaccaccacuu

SEQ ID NO: 2959 - RNA, 21 nt, Artificial Sequence
  Synthetic polynucleotide
ucccaggacgugaccaccauu

SEQ ID NO: 2960 - RNA, 21 nt, Artificial Sequence
  Synthetic polynucleotide
cucccaggacgugaccaccuu

SEQ ID NO: 2961 - RNA, 21 nt, Artificial Sequence
  Synthetic polynucleotide
ggggagugugggggugggauu

SEQ ID NO: 2962 - RNA, 21 nt, Artificial Sequence
  Synthetic polynucleotide
ccucccaggacgugaccacuu

SEQ ID NO: 2963 - RNA, 21 nt, Artificial Sequence
  Synthetic polynucleotide
uccucccaggacgugaccauu

SEQ ID NO: 2964 - RNA, 21 nt, Artificial Sequence
  Synthetic polynucleotide
cuccucccaggacgugaccuu

SEQ ID NO: 2965 - RNA, 21 nt, Artificial Sequence
  Synthetic polynucleotide
gcuccucccaggacgugacuu

SEQ ID NO: 2966 - RNA, 21 nt, Artificial Sequence
  Synthetic polynucleotide
ugcuccucccaggacgugauu

SEQ ID NO: 2967 - RNA, 21 nt, Artificial Sequence
  Synthetic polynucleotide
cugcuccucccaggacguguu

SEQ ID NO: 2968 - RNA, 21 nt, Artificial Sequence
  Synthetic polynucleotide
ucugcuccucccaggacguuu

SEQ ID NO: 2969 - RNA, 21 nt, Artificial Sequence
  Synthetic polynucleotide
uucugcuccucccaggacguu

SEQ ID NO: 2970 - RNA, 21 nt, Artificial Sequence
  Synthetic polynucleotide
uuucugcuccucccaggacuu

SEQ ID NO: 2971 - RNA, 21 nt, Artificial Sequence
  Synthetic polynucleotide
auuucugcuccucccaggauu

SEQ ID NO: 2972 - RNA, 21 nt, Artificial Sequence
  Synthetic polynucleotide
aggggaguguggggguggguu

SEQ ID NO: 2973 - RNA, 21 nt, Artificial Sequence
  Synthetic polynucleotide
aauuucugcuccucccagguu

SEQ ID NO: 2974 - RNA, 21 nt, Artificial Sequence
  Synthetic polynucleotide
aaauuucugcuccucccaguu

SEQ ID NO: 2975 - RNA, 21 nt, Artificial Sequence
  Synthetic polynucleotide
caaauuucugcuccucccauu

SEQ ID NO: 2976 - RNA, 21 nt, Artificial Sequence
  Synthetic polynucleotide
acaaauuucugcuccucccuu

SEQ ID NO: 2977 - RNA, 21 nt, Artificial Sequence
  Synthetic polynucleotide
gacaaauuucugcuccuccuu

SEQ ID NO: 2978 - RNA, 21 nt, Artificial Sequence
  Synthetic polynucleotide
ggacaaauuucugcuccucuu

SEQ ID NO: 2979 - RNA, 21 nt, Artificial Sequence
  Synthetic polynucleotide
uggacaaauuucugcuccuuu

SEQ ID NO: 2980 - RNA, 21 nt, Artificial Sequence
  Synthetic polynucleotide
cuggacaaauuucugcuccuu

SEQ ID NO: 2981 - RNA, 21 nt, Artificial Sequence
  Synthetic polynucleotide
gcuggacaaauuucugcucuu

SEQ ID NO: 2982 - RNA, 21 nt, Artificial Sequence
  Synthetic polynucleotide
ugcuggacaaauuucugcuuu

SEQ ID NO: 2983 - RNA, 21 nt, Artificial Sequence
  Synthetic polynucleotide
gugcuggacaaauuucugcuu

SEQ ID NO: 2984 - RNA, 21 nt, Artificial Sequence
  Synthetic polynucleotide
uaggggagugugggggugguu

SEQ ID NO: 2985 - RNA, 21 nt, Artificial Sequence
  Synthetic polynucleotide
ggugcuggacaaauuucuguu

SEQ ID NO: 2986 - RNA, 21 nt, Artificial Sequence
  Synthetic polynucleotide
uggugcuggacaaauuucuuu

SEQ ID NO: 2987 - RNA, 21 nt, Artificial Sequence
  Synthetic polynucleotide
guggugcuggacaaauuucuu

SEQ ID NO: 2988 - RNA, 21 nt, Artificial Sequence
  Synthetic polynucleotide
uguggugcuggacaaauuuuu

SEQ ID NO: 2989 - RNA, 21 nt, Artificial Sequence
  Synthetic polynucleotide
auguggugcuggacaaauuuu

SEQ ID NO: 2990 - RNA, 21 nt, Artificial Sequence
  Synthetic polynucleotide
uauguggugcuggacaaauuu

SEQ ID NO: 2991 - RNA, 21 nt, Artificial Sequence
  Synthetic polynucleotide
cuauguggugcuggacaaauu

SEQ ID NO: 2992 - RNA, 21 nt, Artificial Sequence
  Synthetic polynucleotide
ccuauguggugcuggacaauu

SEQ ID NO: 2993 - RNA, 21 nt, Artificial Sequence
  Synthetic polynucleotide
ucuuuucugagcugaugguuu

SEQ ID NO: 2994 - RNA, 21 nt, Artificial Sequence
  Synthetic polynucleotide
gucuuuucugagcugaugguu

SEQ ID NO: 2995 - RNA, 21 nt, Artificial Sequence
  Synthetic polynucleotide
agucuuuucugagcugauguu

SEQ ID NO: 2996 - RNA, 21 nt, Artificial Sequence
  Synthetic polynucleotide
gagucuuuucugagcugauuu

SEQ ID NO: 2997 - RNA, 21 nt, Artificial Sequence
  Synthetic polynucleotide
ggagucuuuucugagcugauu

SEQ ID NO: 2998 - RNA, 21 nt, Artificial Sequence
  Synthetic polynucleotide
gggagucuuuucugagcuguu

SEQ ID NO: 2999 - RNA, 21 nt, Artificial Sequence
  Synthetic polynucleotide
ugggagucuuuucugagcuuu

SEQ ID NO: 3000 - RNA, 21 nt, Artificial Sequence
  Synthetic polynucleotide
cugggagucuuuucugagcuu

SEQ ID NO: 3001 - RNA, 21 nt, Artificial Sequence
  Synthetic polynucleotide
gcugggagucuuuucugaguu

SEQ ID NO: 3002 - RNA, 21 nt, Artificial Sequence
  Synthetic polynucleotide
agcugggagucuuuucugauu

SEQ ID NO: 3003 - RNA, 21 nt, Artificial Sequence
  Synthetic polynucleotide
cagcugggagucuuuucuguu

SEQ ID NO: 3004 - RNA, 21 nt, Artificial Sequence
  Synthetic polynucleotide
gcagcugggagucuuuucuuu

SEQ ID NO: 3005 - RNA, 21 nt, Artificial Sequence
  Synthetic polynucleotide
ugcagcugggagucuuuucuu

SEQ ID NO: 3006 - RNA, 21 nt, Artificial Sequence
  Synthetic polynucleotide
cugcagcugggagucuuuuuu

SEQ ID NO: 3007 - RNA, 21 nt, Artificial Sequence
  Synthetic polynucleotide
ccugcagcugggagucuuuuu

SEQ ID NO: 3008 - RNA, 21 nt, Artificial Sequence
  Synthetic polynucleotide
uccugcagcugggagucuuuu

SEQ ID NO: 3009 - RNA, 21 nt, Artificial Sequence
  Synthetic polynucleotide
cuccugcagcugggagucuuu

SEQ ID NO: 3010 - RNA, 21 nt, Artificial Sequence
  Synthetic polynucleotide
ccuccugcagcugggagucuu

SEQ ID NO: 3011 - DNA, 1245 bp, Mus musculus
cacatgggccctggatggaccctgtcccctcccctcccattgcccagggctcttcacctggttcttcaggcttcagccccctccttagcctgggctcttcgtggtgctgagggaccttcagtccggatccagtgccatcatgacaaaggattatcaagatttccagcacctggacaatgataatgaccatcatcaactccggagagggccgcctcccactccacggctcttgcagcgactctgctctggatcccgcctcctcctgctctcctcgagcctcagcattctgttgctggtggttgtctgtgtgatcacatcccaaaattcccaactccgggaagatctgctggctctaaggcagaatttcagcaacctcactgtgagcactgaggaccaggtcaaggccctgagcacccagggaagtagtgtgggaagaaagatgaagttagtggagtcgaagctggaaaaacagcagaaggatctgactgaagatcactccagtttgctactgcacgtgaagcagttagtgtctgacgtgcgaagcttgagctgccagatggctgcatttcggggcaatggctctgaaaggacctgctgccccatcaactgggtggagtatgaaggcagctgctactggttctccagctctgtgaggccttggactgaagctgacaagtactgccagctggaaaatgcccatctggtggtggtgacctccagggatgagcagaacttcctccagcgccacatgggccccttaaacacttggattggcctaactgaccagaacgggccctggaaatgggtggatggaacagactacgagacaggcttccagaattggagaccagagcagccagataactggtacggacatgggcttggaggaggcgaggactgtgcccacttcacgacggatggccgctggaatgacgacgtctgcaggaggccctaccgctgggtctgtgagacaaagttggataaggctaattaggaaccttccttcccctcatttatatccttaattccttgagctgctgaggtttagaactggtagagcctacctaagggtctccccatctccaggaactctcatgtaggatttttaaaggaccggtaaagaatggtgtttgagaaatggtgtatgatgcctggtggtggtaggggtgcgtattgaaacccagcgcgcagttctcttctgtcagcttgttttttttagagtaaaaggaagagaaataaaagttc

SEQ ID NO: 3012 - DNA, 1204 bp, Rattus norvegicus
ctgtccacctggttcttcaggcttcagccccctccttagcctgggctcttcgtggtgctgagggaccttcagtcctgccccagtgctatcatgacaaaggattatcaagatttccagcacttggacaatgagaacgaccaccatcaactccagagagggccacctcccgctccaaggctcttgcagcgactctgctctggattccgtctcttcctgctttccctgggcctcagcatcctgctgctggtggttgtctgtgtgatcacatcccaaaattcccaactccgggaagatctgcgggttctaaggcagaatttcagcaactttaccgtgagcactgaggaccaggtcaaggccctgaccacccagggagagagagtgggaagaaagatgaagttagtcgagtcacagctggaaaaacatcaggaggatctgagggaagaccactctagattgctactgcatgtaaagcagttagtgtctgacgtgcgaagcttgagctgccagatggccgcacttcggggcaatggctctgaaaggatctgctgccccatcaactgggtggagtatgaaggcagctgctactggttctccagctctgtgaagccttggacggaagctgacaagtactgccagctggagaacgcccacctggtggtggtgacttcctgggaggagcagagattcgtccagcaacacatgggccccttaaatacttggattggcctaactgaccagaacggaccctggaaatgggtggatgggacagactatgagacaggcttcaagaactggagaccagggcagccagatgactggtacggacatgggcttggagggggtgaagactgtgcccacttcaccaccgatggccactggaatgatgacgtctgcaggaggccctaccgctgggtctgtgagacagagttgggcaaggccaattaggagcctccattcccctgatttatttcctgagtgccttgagctgtgaggcttagagttgggaggtcctactcaagggtctccccatctttgggaactttcatctaggattttaaggggctggtaaagaatggtgtttgaggaatgtggtatgatgcctggtggtggtggtggtggtggttattggaacccatgacactttgtgcagtgtgcagcttactactgccaacttgtttttgagagtaaaagaaggaagataaac

SEQ ID NO: 3013 - DNA, 1417 bp, Macaca fascicularis
ttactgtccaaagtcccgggcactggagatgccacgtttggcgtgcttggacacacagacacgcagacacagagacaccggggcccagggccctcctatggaccctgcccgctcccactccatcgtccacggctgtccacccacccccattctccaagcttcagcccccctccttagtccggcatctgcacagcactgaagaacctgggagtcagaccctgagaccccgagcaactctagtcctcgtgagcccccacctcagccccagcctcagccttgactcagtcccagctccagcaccagccctatcatgaccaaggagtatcaggacctgcagcatctggacaatgaggagagtgaccaccatcagctcggaaaagggccacctcctccgcagtccctcctgcggcgtctctgctccggccctcgcctcctcctgctctccctgggcctcagcctcctgctgctggtggttgtctgtgtgatcggatcccaaaacgcccagctgcagcgggagctgcggggcctgagagagacgctcagcaacttcacagcgagcaccgaggcccaggtcaagggcttgagcacccagggaggcaatgtgggaagaaagatgaagtcgctggagtcccagctggagaaacagcagaaggacttgagtgaagatcactccagcctgctgctccacgtgaagcagttcgtgtctgacctgcggagcctgagctgtcagatggcggcgctccagggcaatggctcggaaagggcctgctgcccagtcaactgggtggagcacgagcgcagctgctactggttctctcgctccgggaaggcctgggccgacgccgacaactactgccggctggaggacgcgcacctggtggtggtcacgtcctgggaggagcagaaatttgtccagcaccacataggtcctgtgaacacctggatgggcctccacgaccaaaacgggccctggaagtgggtggacgggacggactacgagacgggcttcaagaactggagaccggagcagccggacgactggtacggccacgggctcgggggaggggaggactgtgcccacttcaccgacgacggccgctggaacgacgacgtctgccagaggccctaccgctgggtctgcgagacagagctggacaaggccagtcaggagccacctctcctttaatttatttcttcagtgcctcgacctgccgcaggggtccggggttgggaatccgcccgtctgggggcctcttctgctttctcggggattttcatgtaggattttaagggaaggggaaggataggatgatgttgggaaggtgggggacttgaaacccgtggcgctttctgtagtttgcacgttatcattgtcaacttttttttttttttagagtaaaaagaaatatacctaaac

SEQ ID NO: 3014 - DNA, 21 bp, Artificial Sequence
  Synthetic polynucleotide
  modified_base (1)..(21): Positions 4-7, 9-10, 12-13, 17-19 2'-O-methyl ribonucleotide
  modified_base (21)..(21): phosphorothioate linked nucleoside
aggcccuaccgcugggucutt

SEQ ID NO: 3015 - DNA, 21 bp, Artificial Sequence
  Synthetic polynucleotide
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
aggcccuaccgcugggucuuu

SEQ ID NO: 3016 - DNA, 21 bp, Artificial Sequence
  Synthetic polynucleotide
  modified_base (1)..(21): Positions 1, 3, 5, 7-8, 10-11, 13, 15, 17, 19, 21 2'-deoxy-2'-fluoro ("2'-fluoro") ribonucleotide
  modified_base (1)..(21): Positions 2, 4, 6, 9, 12, 14, 16, 18, 20 2'-O-methyl ribonucleotide
aggcccuaccgcugggucuuu

SEQ ID NO: 3017 - DNA, 21 bp, Artificial Sequence
  Synthetic polynucleotide
  modified_base (1)..(21): Positions 1, 3, 5, 7, 10-11, 13, 15, 17, 19, 21 2'-deoxy-2'-fluoro ("2'-fluoro") ribonucleotide
  modified_base (1)..(21): Positions 2, 4, 6, 8-9, 12, 14, 16, 18, 20 2'-O-methyl ribonucleotide
aggcccuaccgcugggucuuu

SEQ ID NO: 3018 - DNA, 21 bp, Artificial Sequence
  Synthetic polynucleotide
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
aggcccuaccgcugggucuuu

SEQ ID NO: 3019 - DNA, 21 bp, Artificial Sequence
  Synthetic polynucleotide
  modified_base (1)..(21): Positions 1, 3, 5, 7, 9-10, 12-13, 15, 17, 19, 21 2'-deoxy-2'-fluoro ("2'-fluoro") ribonucleotide
  modified_base (1)..(21): Positions 2, 4, 6, 8, 11, 14, 16, 18, 20 2'-O-methyl ribonucleotide
aggcccuaccgcugggucuuu

SEQ ID NO: 3020 - DNA, 21 bp, Artificial Sequence
  Synthetic polynucleotide
  modified_base (1)..(21): Positions 1, 3, 5, 7, 9-10, 13, 15, 17, 19, 21 2'-deoxy-2'-fluoro ("2'-fluoro") ribonucleotide
  modified_base (1)..(21): Positions 2, 4, 6, 8, 11-12, 14, 16, 18, 20 2'-O-methyl ribonucleotide
aggcccuaccgcugggucuuu

SEQ ID NO: 3021 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
aggcccuaccgcugggucuuu

SEQ ID NO: 3022 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
aggcccuaccgcugggucuuu

SEQ ID NO: 3023 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (2)..(3): phosphorothioate linked nucleoside
aggcccuaccgcugggucuuu

SEQ ID NO: 3024 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 1, 4, 6-7, 10, 12, 14, 16, 18, 20 2'-O-methyl ribonucleotide
aggcccuaccgcugggucuuu

SEQ ID NO: 3025 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
  modified_base (2)..(3): phosphorothioate linked nucleoside
aggcccuaccgcugggucuuu

SEQ ID NO: 3026 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
aggcccuaccgcugggucuuu

SEQ ID NO: 3027 - DNA, 21 bp, Artificial Sequence
  Synthetic polynucleotide
  modified_base (1)..(21): Positions 1, 3, 5-6, 9, 11, 13, 15, 17, 19, 21 2'-deoxy-2'-fluoro ("2'-fluoro") ribonucleotide
  modified_base (1)..(21): Positions 2, 4, 7-8, 10, 12, 14, 16, 18, 20 2'-O-methyl ribonucleotide
aggcccuaccgcugggucuuu

SEQ ID NO: 3028 - DNA, 21 bp, Artificial Sequence
  Synthetic polynucleotide
  modified_base (1)..(21): Positions 1, 3, 6-7, 9, 11, 13, 15, 17, 19, 21 2'-deoxy-2'-fluoro ("2'-fluoro") ribonucleotide
  modified_base (1)..(21): Positions 2, 4-5, 8, 10, 12, 14, 16, 18, 20 2'-O-methyl ribonucleotide
aggcccuaccgcugggucuuu

SEQ ID NO: 3029 - DNA, 21 bp, Artificial Sequence
  Synthetic polynucleotide
  modified_base (1)..(21): Positions 1, 3-4, 7, 9, 11, 13, 15, 17, 19, 21 2'-deoxy-2'-fluoro ("2'-fluoro") ribonucleotide
  modified_base (1)..(21): Positions 2, 5-6, 8, 10, 12, 14, 16, 18, 20 2'-O-methyl ribonucleotide
aggcccuaccgcugggucuuu

SEQ ID NO: 3030 - DNA, 21 bp, Artificial Sequence
  Synthetic polynucleotide
  modified_base (1)..(21): Positions 1, 4-5, 7, 9, 11, 13, 15, 17, 19, 21 2'-deoxy-2'-fluoro ("2'-fluoro") ribonucleotide
  modified_base (1)..(21): Positions 2-3, 6, 8, 10, 12, 14, 16, 18, 20 2'-O-methyl ribonucleotide
aggcccuaccgcugggucuuu

SEQ ID NO: 3031 - DNA, 21 bp, Artificial Sequence
  Synthetic polynucleotide
  modified_base (1)..(21): Positions 1-2, 5, 7, 9, 11, 13, 15, 17, 19, 21 2'-deoxy-2'-fluoro ("2'-fluoro") ribonucleotide
  modified_base (1)..(21): Positions 3-4, 6, 8, 10, 12, 14, 16, 18, 20 2'-O-methyl ribonucleotide
aggcccuaccgcugggucuuu

SEQ ID NO: 3032 - DNA, 21 bp, Artificial Sequence
  Synthetic polynucleotide
  modified_base (1)..(21): Positions 2-3, 5, 7, 9, 11, 13, 15, 17, 19, 21 2'-deoxy-2'-fluoro ("2'-fluoro") ribonucleotide
  modified_base (1)..(21): Positions 1, 4, 6, 8, 10, 12, 14, 16, 18, 20 2'-O-methyl ribonucleotide
aggcccuaccgcugggucuuu

SEQ ID NO: 3033 - DNA, 21 bp, Artificial Sequence
  Synthetic polynucleotide
  modified_base (1)..(21): Positions 3, 5, 7, 9, 11, 13, 15, 17, 19, 21 2'-deoxy-2'-fluoro ("2'-fluoro") ribonucleotide
  modified_base (1)..(21): Positions 1-2, 4, 6, 8, 10, 12, 14, 16, 18, 20 2'-O-methyl ribonucleotide
aggcccuaccgcugggucuuu

SEQ ID NO: 3034 - DNA, 21 bp, Artificial Sequence
  Synthetic polynucleotide
  modified_base (1)..(21): Positions 1, 3, 5, 7, 9, 11, 14-15, 17, 19, 21 2'-deoxy-2'-fluoro ("2'-fluoro") ribonucleotide
  modified_base (1)..(21): Positions 2, 4, 6, 8, 10, 12-13, 16, 18, 20 2'-O-methyl ribonucleotide
aggcccuaccgcugggucuuu

SEQ ID NO: 3035 - DNA, 21 bp, Artificial Sequence
  Synthetic polynucleotide
  modified_base (1)..(21): Positions 1, 3, 5, 7, 9, 11, 13-14, 17, 19, 21 2'-deoxy-2'-fluoro ("2'-fluoro") ribonucleotide
  modified_base (1)..(21): Positions 2, 4, 6, 8, 10, 12, 15-16, 18, 20 2'-O-methyl ribonucleotide
aggcccuaccgcugggucuuu

SEQ ID NO: 3036 - DNA, 21 bp, Artificial Sequence
  Synthetic polynucleotide
  modified_base (1)..(21): Positions 1, 3, 5, 7, 9, 11, 13, 15, 16-17, 19, 21 2'-deoxy-2'-fluoro ("2'-fluoro") ribonucleotide
  modified_base (1)..(21): Positions 2, 4, 6, 8, 10, 12, 14-15, 18, 20 2'-O-methyl ribonucleotide
aggcccuaccgcugggucuuu

SEQ ID NO: 3037 - DNA, 21 bp, Artificial Sequence
  Synthetic polynucleotide
  modified_base (1)..(21): Positions 1, 3, 5, 7, 9, 11, 13, 15-16, 19, 21 2'-deoxy-2'-fluoro ("2'-fluoro") ribonucleotide
  modified_base (1)..(21): Positions 2, 4, 6, 8, 10, 12, 14, 17-18, 20 2'-O-methyl ribonucleotide
aggcccuaccgcugggucuuu

SEQ ID NO: 3038 - DNA, 21 bp, Artificial Sequence
  Synthetic polynucleotide
  modified_base (1)..(21): Positions 1, 3, 5, 7, 9, 11, 13, 15, 18-19, 21 2'-deoxy-2'-fluoro ("2'-fluoro") ribonucleotide
  modified_base (1)..(21): Positions 2, 4, 6, 8, 10, 12, 14, 16-17, 20 2'-O-methyl ribonucleotide
aggcccuaccgcugggucuuu

SEQ ID NO: 3039 - DNA, 21 bp, Artificial Sequence
  Synthetic polynucleotide
  modified_base (1)..(21): Positions 1, 3, 5, 7, 9, 11, 13, 15, 17-18, 21 2'-deoxy-2'-fluoro ("2'-fluoro") ribonucleotide
  modified_base (1)..(21): Positions 2, 4, 6, 8, 10, 12, 14, 16, 19-20 2'-O-methyl ribonucleotide
aggcccuaccgcugggucuuu

SEQ ID NO: 3040 - DNA, 21 bp, Artificial Sequence
  Synthetic polynucleotide
  modified_base (1)..(21): Positions 1, 3, 5, 7, 9, 11, 13, 15, 17, 20-21 2'-deoxy-2'-fluoro ("2'-fluoro") ribonucleotide
  modified_base (1)..(21): Positions 2, 4, 6, 8, 10, 12, 14, 16, 18-19 2'-O-methyl ribonucleotide
aggcccuaccgcugggucuuu

SEQ ID NO: 3041 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
aggcccuaccgcugggucuuu

SEQ ID NO: 3042 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
aggcccuaccgcugggucuuu

SEQ ID NO: 3043 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
aggcccuaccgcugggucuuu

SEQ ID NO: 3044 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
aggcccuaccgcugggucuuu

SEQ ID NO: 3045 - DNA, 21 bp, Artificial Sequence
  Synthetic polynucleotide
  modified_base (1)..(21): Positions 2, 14, 19 2'-O-methyl ribonucleotide
  modified_base (21)..(21): phosphorothioate linked nucleoside
gugggaagaaagaugaagutt

SEQ ID NO: 3046 - DNA, 21 bp, Artificial Sequence
  Synthetic polynucleotide
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
gugggaagaaagaugaaguuu

SEQ ID NO: 3047 - DNA, 21 bp, Artificial Sequence
  Synthetic polynucleotide
  modified_base (1)..(21): Positions 1, 3, 5, 7-8, 10-11, 13, 15, 17, 19, 21 2'-deoxy-2'-fluoro ("2'-fluoro") ribonucleotide
  modified_base (1)..(21): Positions 2, 4, 6, 9, 12, 14, 16, 18, 20 2'-O-methyl ribonucleotide
gugggaagaaagaugaaguuu

SEQ ID NO: 3048 - DNA, 21 bp, Artificial Sequence
  Synthetic polynucleotide
  modified_base (1)..(21): Positions 1, 3, 5, 7, 10-11, 13, 15, 17, 19, 21 2'-deoxy-2'-fluoro ("2'-fluoro") ribonucleotide
  modified_base (1)..(21): Positions 2, 4, 6, 8-9, 12, 14, 16, 18, 20 2'-O-methyl ribonucleotide
gugggaagaaagaugaaguuu

SEQ ID NO: 3049 - DNA, 21 bp, Artificial Sequence
  Synthetic polynucleotide
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
gugggaagaaagaugaaguuu

SEQ ID NO: 3050 - DNA, 21 bp, Artificial Sequence
  Synthetic polynucleotide
  modified_base (1)..(21): Positions 1, 3, 5, 7, 9-10, 12-13, 15, 17, 19, 21 2'-deoxy-2'-fluoro ("2'-fluoro") ribonucleotide
  modified_base (1)..(21): Positions 2, 4, 6, 8, 11, 14, 16, 18, 20 2'-O-methyl ribonucleotide
gugggaagaaagaugaaguuu

SEQ ID NO: 3051 - DNA, 21 bp, Artificial Sequence
  Synthetic polynucleotide
  modified_base (1)..(21): Positions 1, 3, 5, 7, 9-10, 13, 15, 17, 19, 21 2'-deoxy-2'-fluoro ("2'-fluoro") ribonucleotide
  modified_base (1)..(21): Positions 2, 4, 6, 8, 11-12, 14, 16, 18, 20 2'-O-methyl ribonucleotide
gugggaagaaagaugaaguuu

SEQ ID NO: 3052 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
gugggaagaaagaugaaguuu

SEQ ID NO: 3053 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
gugggaagaaagaugaaguuu

SEQ ID NO: 3054 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (2)..(3): phosphorothioate linked nucleoside
gugggaagaaagaugaaguuu

SEQ ID NO: 3055 - DNA, 21 bp, Artificial Sequence
  Positions 1, 3, 5, 7, 9, 11, 13, 15, 17, 19, 21 2'-deoxy-2'-fluoro ("2'-fluoro") ribonucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
gugggaagaaagaugaaguuu

SEQ ID NO: 3056 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
  modified_base (2)..(3): phosphorothioate linked nucleoside
gugggaagaaagaugaaguuu

SEQ ID NO: 3057 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
gugggaagaaagaugaaguuu

SEQ ID NO: 3058 - DNA, 21 bp, Artificial Sequence
  Synthetic polynucleotide
  modified_base (1)..(21): Positions 1, 3, 5-6, 9, 11, 13, 15, 17, 19, 21 2'-deoxy-2'-fluoro ("2'-fluoro") ribonucleotide
  modified_base (1)..(21): Positions 2, 4, 7-8, 10, 12, 14, 16, 18, 20 2'-O-methyl ribonucleotide
gugggaagaaagaugaaguuu

SEQ ID NO: 3059 - DNA, 21 bp, Artificial Sequence
  Synthetic polynucleotide
  modified_base (1)..(21): Positions 1, 3, 6-7, 9, 11, 13, 15, 17, 19, 21 2'-deoxy-2'-fluoro ("2'-fluoro") ribonucleotide
  modified_base (1)..(21): Positions 2, 4-5, 8, 10, 12, 14, 16, 18, 20 2'-O-methyl ribonucleotide
gugggaagaaagaugaaguuu

SEQ ID NO: 3060 - DNA, 21 bp, Artificial Sequence
  Synthetic polynucleotide
  modified_base (1)..(21): Positions 1, 3-4, 7, 9, 11, 13, 15, 17, 19, 21 2'-deoxy-2'-fluoro ("2'-fluoro") ribonucleotide
  modified_base (1)..(21): Positions 2, 5-6, 8, 10, 12, 14, 16, 18, 20 2'-O-methyl ribonucleotide
gugggaagaaagaugaaguuu

SEQ ID NO: 3061 - DNA, 21 bp, Artificial Sequence
  Synthetic polynucleotide
  modified_base (1)..(21): Positions 1, 4-5, 7, 9, 11, 13, 15, 17, 19, 21 2'-deoxy-2'-fluoro ("2'-fluoro") ribonucleotide
  modified_base (1)..(21): Positions 2-3, 6, 8, 10, 12, 14, 16, 18, 20 2'-O-methyl ribonucleotide
gugggaagaaagaugaaguuu

SEQ ID NO: 3062 - DNA, 21 bp, Artificial Sequence
  Synthetic polynucleotide
  modified_base (1)..(21): Positions 1-2, 5, 7, 9, 11, 13, 15, 17, 19, 21 2'-deoxy-2'-fluoro ("2'-fluoro") ribonucleotide
  modified_base (1)..(21): Positions 3-4, 6, 8, 10, 12, 14, 16, 18, 20 2'-O-methyl ribonucleotide
gugggaagaaagaugaaguuu

SEQ ID NO: 3063 - DNA, 21 bp, Artificial Sequence
  Synthetic polynucleotide
  modified_base (1)..(21): Positions 2-3, 5, 7, 9, 11, 13, 15, 17, 19, 21 2'-deoxy-2'-fluoro ("2'-fluoro") ribonucleotide
  modified_base (1)..(21): Positions 1, 4, 6, 8, 10, 12, 14, 16, 18, 20 2'-O-methyl ribonucleotide
gugggaagaaagaugaaguuu

SEQ ID NO: 3064 - DNA, 21 bp, Artificial Sequence
  Synthetic polynucleotide
  modified_base (1)..(21): Positions 3, 5, 7, 9, 11, 13, 15, 17, 19, 21 2'-deoxy-2'-fluoro ("2'-fluoro") ribonucleotide
  modified_base (1)..(21): Positions 1-2, 4, 6, 8, 10, 12, 14, 16, 18, 20 2'-O-methyl ribonucleotide
gugggaagaaagaugaaguuu

SEQ ID NO: 3065 - DNA, 21 bp, Artificial Sequence
  Synthetic polynucleotide
  modified_base (1)..(21): Positions 1, 3, 5, 7, 9, 11, 14-15, 17, 19, 21 2'-deoxy-2'-fluoro ("2'-fluoro") ribonucleotide
  modified_base (1)..(21): Positions 2, 4, 6, 8, 10, 12-13, 16, 18, 20 2'-O-methyl ribonucleotide
gugggaagaaagaugaaguuu

SEQ ID NO: 3066 - DNA, 21 bp, Artificial Sequence
  Synthetic polynucleotide
  modified_base (1)..(21): Positions 1, 3, 5, 7, 9, 11, 13-14, 17, 19, 21 2'-deoxy-2'-fluoro ("2'-fluoro") ribonucleotide
  modified_base (1)..(21): Positions 2, 4, 6, 8, 10, 12, 15-16, 18, 20 2'-O-methyl ribonucleotide
gugggaagaaagaugaaguuu

SEQ ID NO: 3067 - DNA, 21 bp, Artificial Sequence
  Synthetic polynucleotide
  modified_base (1)..(21): Positions 1, 3, 5, 7, 9, 11, 13, 16-17, 19, 21 2'-deoxy-2'-fluoro ("2'-fluoro") ribonucleotide
  modified_base (1)..(21): Positions 2, 4, 6, 8, 10, 12, 14-15, 18, 20 2'-O-methyl ribonucleotide
gugggaagaaagaugaaguuu

SEQ ID NO: 3068 - DNA, 21 bp, Artificial Sequence
  Synthetic polynucleotide
  modified_base (1)..(21): Positions 1, 3, 5, 7, 9, 11, 13, 15-16, 19, 21 2'-deoxy-2'-fluoro ("2'-fluoro") ribonucleotide
  modified_base (1)..(21): Positions 2, 4, 6, 8, 10, 12, 14, 17-18, 20 2'-O-methyl ribonucleotide
gugggaagaaagaugaaguuu

SEQ ID NO: 3069 - DNA, 21 bp, Artificial Sequence
  Synthetic polynucleotide
  modified_base (1)..(21): Positions 1, 3, 5, 7, 9, 11, 13, 15, 18-19, 21 2'-deoxy-2'-fluoro ("2'-fluoro") ribonucleotide
  modified_base (1)..(21): Positions 2, 4, 6, 8, 10, 12, 14, 16-17, 20 2'-O-methyl ribonucleotide
gugggaagaaagaugaaguuu

SEQ ID NO: 3070 - DNA, 21 bp, Artificial Sequence
  Synthetic polynucleotide
  modified_base (1)..(21): Positions 1, 3, 5, 7, 9, 11, 13, 15, 17-18, 21 2'-deoxy-2'-fluoro ("2'-fluoro") ribonucleotide
  modified_base (1)..(21): Positions 2, 4, 6, 8, 10, 12, 14, 16, 19-20 2'-O-methyl ribonucleotide
gugggaagaaagaugaaguuu

SEQ ID NO: 3071 - DNA, 21 bp, Artificial Sequence
  Synthetic polynucleotide
  modified_base (1)..(21): Positions 1, 3, 5, 7, 9, 11, 13, 15, 17, 20-21 2'-deoxy-2'-fluoro ("2'-fluoro") ribonucleotide
  modified_base (1)..(21): Positions 2, 4, 6, 8, 10, 12, 14, 16, 18-19 2'-O-methyl ribonucleotide
gugggaagaaagaugaaguuu

SEQ ID NO: 3072 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
gugggaagaaagaugaaguuu

SEQ ID NO: 3073 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
gugggaagaaagaugaaguuu

SEQ ID NO: 3074 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
gugggaagaaagaugaaguuu

SEQ ID NO: 3075 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
gugggaagaaagaugaaguuu

SEQ ID NO: 3076 - DNA, 21 bp, Artificial Sequence
  Synthetic polynucleotide
  modified_base (1)..(21): Positions 5, 9-12, 18-19 2'-O-methyl ribonucleotide
  modified_base (21)..(21): phosphorothioate linked nucleoside
gagacgggcuucaagaacutt

SEQ ID NO: 3077 - DNA, 21 bp, Artificial Sequence
  Synthetic polynucleotide
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
gagacgggcuucaagaacuuu

SEQ ID NO: 3078 - DNA, 21 bp, Artificial Sequence
  Synthetic polynucleotide
  modified_base (1)..(21): Positions 1, 3, 5, 7-8, 10-11, 13, 15, 17, 19, 21 2'-deoxy-2'-fluoro ("2'-fluoro") ribonucleotide
  modified_base (1)..(21): Positions 2, 4, 6, 9, 12, 14, 16, 18, 20 2'-O-methyl ribonucleotide
gagacgggcuucaagaacuuu

SEQ ID NO: 3079 - DNA, 21 bp, Artificial Sequence
  Synthetic polynucleotide
  modified_base (1)..(21): Positions 1, 3, 5, 7, 10-11, 13, 15, 17, 19, 21 2'-deoxy-2'-fluoro ("2'-fluoro") ribonucleotide
  modified_base (1)..(21): Positions 2, 4, 6, 8-9, 12, 14, 16, 18, 20 2'-O-methyl ribonucleotide
gagacgggcuucaagaacuuu

SEQ ID NO: 3080 - DNA, 21 bp, Artificial Sequence
  Synthetic polynucleotide
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
gagacgggcuucaagaacuuu

SEQ ID NO: 3081 - DNA, 21 bp, Artificial Sequence
  Synthetic polynucleotide
  modified_base (1)..(21): Positions 1, 3, 5, 7, 9-10, 12-13, 15, 17, 19, 21 2'-deoxy-2'-fluoro ("2'-fluoro") ribonucleotide
  modified_base (1)..(21): Positions 2, 4, 6, 8, 11, 14, 16, 18, 20 2'-O-methyl ribonucleotide
gagacgggcuucaagaacuuu

SEQ ID NO: 3082 - DNA, 21 bp, Artificial Sequence
  Synthetic polynucleotide
  modified_base (1)..(21): Positions 1, 3, 5, 7, 9-10, 13, 15, 17, 19, 21 2'-deoxy-2'-fluoro ("2'-fluoro") ribonucleotide
  modified_base (1)..(21): Positions 2, 4, 6, 8, 11-12, 14, 16, 18, 20 2'-O-methyl ribonucleotide
gagacgggcuucaagaacuuu

SEQ ID NO: 3083 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
gagacgggcuucaagaacuuu

SEQ ID NO: 3084 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
gagacgggcuucaagaacuuu

SEQ ID NO: 3085 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (2)..(3): phosphorothioate linked nucleoside
gagacgggcuucaagaacuuu

SEQ ID NO: 3086 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
gagacgggcuucaagaacuuu

SEQ ID NO: 3087 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
  modified_base (2)..(3): phosphorothioate linked nucleoside
gagacgggcuucaagaacuuu

SEQ ID NO: 3088 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
gagacgggcuucaagaacuuu

SEQ ID NO: 3089 - DNA, 21 bp, Artificial Sequence
  Synthetic polynucleotide
  modified_base (1)..(21): Positions 1, 3, 5-6, 9, 11, 13, 15, 17, 19, 21 2'-deoxy-2'-fluoro ("2'-fluoro") ribonucleotide
  modified_base (1)..(21): Positions 2, 4, 7-8, 10, 12, 14, 16, 18, 20 2'-O-methyl ribonucleotide
gagacgggcuucaagaacuuu

SEQ ID NO: 3090 - DNA, 21 bp, Artificial Sequence
  Synthetic polynucleotide
  modified_base (1)..(21): Positions 1, 3, 6-7, 9, 11, 13, 15, 17, 19, 21 2'-deoxy-2'-fluoro ("2'-fluoro") ribonucleotide
  modified_base (1)..(21): Positions 2, 4-5, 8, 10, 12, 14, 16, 18, 20 2'-O-methyl ribonucleotide
gagacgggcuucaagaacuuu

SEQ ID NO: 3091 - DNA, 21 bp, Artificial Sequence
  Synthetic polynucleotide
  modified_base (1)..(21): Positions 1, 3-4, 7, 9, 11, 13, 15, 17, 19, 21 2'-deoxy-2'-fluoro ("2'-fluoro") ribonucleotide
  modified_base (1)..(21): Positions 2, 5-6, 8, 10, 12, 14, 16, 18, 20 2'-O-methyl ribonucleotide
gagacgggcuucaagaacuuu

SEQ ID NO: 3092 - DNA, 21 bp, Artificial Sequence
  Synthetic polynucleotide
  modified_base (1)..(21): Positions 1, 4-5, 7, 9, 11, 13, 15, 17, 19, 21 2'-deoxy-2'-fluoro ("2'-fluoro") ribonucleotide
  modified_base (1)..(21): Positions 2-3, 6, 8, 10, 12, 14, 16, 18, 20 2'-O-methyl ribonucleotide
gagacgggcuucaagaacuuu

SEQ ID NO: 3093 - DNA, 21 bp, Artificial Sequence
  Synthetic polynucleotide
  modified_base (1)..(21): Positions 1-2, 5, 7, 9, 11, 13, 15, 17, 19, 21 2'-deoxy-2'-fluoro ("2'-fluoro") ribonucleotide
  modified_base (1)..(21): Positions 3-4, 6, 8, 10, 12, 14, 16, 18, 20 2'-O-methyl ribonucleotide
gagacgggcuucaagaacuuu

SEQ ID NO: 3094 - DNA, 21 bp, Artificial Sequence
  Synthetic polynucleotide
  modified_base (1)..(21): Positions 2-3, 5, 7, 9, 11, 13, 15, 17, 19, 21 2'-deoxy-2'-fluoro ("2'-fluoro") ribonucleotide
  modified_base (1)..(21): Positions 1, 4, 6, 8, 10, 12, 14, 16, 18, 20 2'-O-methyl ribonucleotide
gagacgggcuucaagaacuuu

SEQ ID NO: 3095 - DNA, 21 bp, Artificial Sequence
  Synthetic polynucleotide
  modified_base (1)..(21): Positions 3, 5, 7, 9, 11, 13, 15, 17, 19, 21 2'-deoxy-2'-fluoro ("2'-fluoro") ribonucleotide
  modified_base (1)..(21): Positions 1-2, 4, 6, 8, 10, 12, 14, 16, 18, 20 2'-O-methyl ribonucleotide
gagacgggcuucaagaacuuu

SEQ ID NO: 3096 - DNA, 21 bp, Artificial Sequence
  Synthetic polynucleotide
  modified_base (1)..(21): Positions 1, 3, 5, 7, 9, 11, 14-15, 17, 19, 21 2'-deoxy-2'-fluoro ("2'-fluoro") ribonucleotide
  modified_base (1)..(21): Positions 2, 4, 6, 8, 10, 12-13, 16, 18, 20 2'-O-methyl ribonucleotide
gagacgggcuucaagaacuuu

SEQ ID NO: 3097 - DNA, 21 bp, Artificial Sequence
  Synthetic polynucleotide
  modified_base (1)..(21): Positions 1, 3, 5, 7, 9, 11, 13-14, 17, 19, 21 2'-deoxy-2'-fluoro ("2'-fluoro") ribonucleotide
  modified_base (1)..(21): Positions 2, 4, 6, 8, 10, 12, 15-16, 18, 20 2'-O-methyl ribonucleotide
gagacgggcuucaagaacuuu

SEQ ID NO: 3098 - DNA, 21 bp, Artificial Sequence
  Synthetic polynucleotide
  modified_base (1)..(21): Positions 1, 3, 5, 7, 9, 11, 13, 16-17, 19, 21 2'-deoxy-2'-fluoro ("2'-fluoro") ribonucleotide
  modified_base (1)..(21): Positions 2, 4, 6, 8, 10, 12, 14-15, 18, 20 2'-O-methyl ribonucleotide
gagacgggcuucaagaacuuu

SEQ ID NO: 3099 - DNA, 21 bp, Artificial Sequence
  Synthetic polynucleotide
  modified_base (1)..(21): Positions 1, 3, 5, 7, 9, 11, 13, 15-16, 19, 21 2'-deoxy-2'-fluoro ("2'-fluoro") ribonucleotide
  modified_base (1)..(21): Positions 2, 4, 6, 8, 10, 12, 14, 17-18, 20 2'-O-methyl ribonucleotide
gagacgggcuucaagaacuuu

SEQ ID NO: 3100 - DNA, 21 bp, Artificial Sequence
  Synthetic polynucleotide
  modified_base (1)..(21): Positions 1, 3, 5, 7, 9, 11, 13, 15, 17, 18-19 2'-deoxy-2'-fluoro ("2'-fluoro") ribonucleotide
  modified_base (1)..(21): Positions 2, 4, 6, 8, 10, 12, 14, 16-17, 20 2'-O-methyl ribonucleotide
gagacgggcuucaagaacuuu

SEQ ID NO: 3101 - DNA, 21 bp, Artificial Sequence
  Synthetic polynucleotide
  modified_base (1)..(21): Positions 1, 3, 5, 7, 9, 11, 13, 15, 17-18, 21 2'-deoxy-2'-fluoro ("2'-fluoro") ribonucleotide
  modified_base (1)..(21): Positions 2, 4, 6, 8, 10, 12, 14, 16, 19-20 2'-O-methyl ribonucleotide
gagacgggcuucaagaacuuu

SEQ ID NO: 3102 - DNA, 21 bp, Artificial Sequence
  Synthetic polynucleotide
  modified_base (1)..(21): Positions 1, 3, 5, 7, 9, 11, 13, 15, 17, 20-21 2'-deoxy-2'-fluoro ("2'-fluoro") ribonucleotide
  modified_base (1)..(21): Positions 2, 4, 6, 8, 10, 12, 14, 16, 18-19 2'-O-methyl ribonucleotide
gagacgggcuucaagaacuuu

SEQ ID NO: 3103 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
gagacgggcuucaagaacuuu

SEQ ID NO: 3104 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
gagacgggcuucaagaacuuu

SEQ ID NO: 3105 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
gagacgggcuucaagaacuuu

SEQ ID NO: 3106 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
gagacgggcuucaagaacuuu

SEQ ID NO: 3107 - DNA, 21 bp, Artificial Sequence
  Synthetic polynucleotide
  modified_base (1)..(21): Positions 4, 6, 9-10, 12-13, 15-16, 19 2'-O-methyl ribonucleotide
  modified_base (21)..(21): phosphorothioate linked nucleoside
gagcgcagcugcuacuggutt

SEQ ID NO: 3108 - DNA, 21 bp, Artificial Sequence
  Synthetic polynucleotide
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
gagcgcagcugcuacugguuu

SEQ ID NO: 3109 - DNA, 21 bp, Artificial Sequence
  Synthetic polynucleotide
  modified_base (1)..(21): Positions 1, 3, 5, 7-8, 10-11, 13, 15, 17, 19, 21 2'-deoxy-2'-fluoro ("2'-fluoro") ribonucleotide
  modified_base (1)..(21): Positions 2, 4, 6, 9, 12, 14, 16, 18, 20 2'-O-methyl ribonucleotide
gagcgcagcugcuacugguuu

SEQ ID NO: 3110 - DNA, 21 bp, Artificial Sequence
  Synthetic polynucleotide
  modified_base (1)..(21): Positions 1, 3, 5, 7, 10-11, 13, 15, 17, 19, 21 2'-deoxy-2'-fluoro ("2'-fluoro") ribonucleotide
  modified_base (1)..(21): Positions 2, 4, 6, 8-9, 12, 14, 16, 18, 20 2'-O-methyl ribonucleotide
gagcgcagcugcuacugguuu

SEQ ID NO: 3111 - DNA, 21 bp, Artificial Sequence
  Synthetic polynucleotide
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
gagcgcagcugcuacugguuu

SEQ ID NO: 3112 - DNA, 21 bp, Artificial Sequence
  Synthetic polynucleotide
  modified_base (1)..(21): Positions 1, 3, 5, 7, 9-10, 12-13, 15, 17, 19, 21 2'-deoxy-2'-fluoro ("2'-fluoro") ribonucleotide
  modified_base (1)..(21): Positions 2, 4, 6, 8, 11, 14, 16, 18, 20 2'-O-methyl ribonucleotide
gagcgcagcugcuacugguuu

SEQ ID NO: 3113 - DNA, 21 bp, Artificial Sequence
  Synthetic polynucleotide
  modified_base (1)..(21): Positions 1, 3, 5, 7, 9-10, 13, 15, 17, 19, 21 2'-deoxy-2'-fluoro ("2'-fluoro") ribonucleotide
  modified_base (1)..(21): Positions 2, 4, 6, 8, 11-12, 14, 16, 18, 20 2'-O-methyl ribonucleotide
gagcgcagcugcuacugguuu

SEQ ID NO: 3114 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
gagcgcagcugcuacugguuu

SEQ ID NO: 3115 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
gagcgcagcugcuacugguuu

SEQ ID NO: 3116 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (2)..(3): phosphorothioate linked nucleoside
gagcgcagcugcuacugguuu

SEQ ID NO: 3117 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
gagcgcagcugcuacugguuu

SEQ ID NO: 3118 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
  modified_base (2)..(3): phosphorothioate linked nucleoside
gagcgcagcugcuacugguuu

SEQ ID NO: 3119 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
gagcgcagcugcuacugguuu

SEQ ID NO: 3120 - DNA, 21 bp, Artificial Sequence
  Synthetic polynucleotide
  modified_base (1)..(21): Positions 1, 3, 5-6, 9, 11, 13, 15, 17, 19, 21 2'-deoxy-2'-fluoro ("2'-fluoro") ribonucleotide
  modified_base (1)..(21): Positions 2, 4, 7-8, 10, 12, 14, 16, 18, 20 2'-O-methyl ribonucleotide
gagcgcagcugcuacugguuu

SEQ ID NO: 3121 - DNA, 21 bp, Artificial Sequence
  Synthetic polynucleotide
  modified_base (1)..(21): Positions 1, 3, 6-7, 9, 11, 13, 15, 17, 19, 21 2'-deoxy-2'-fluoro ("2'-fluoro") ribonucleotide
  modified_base (1)..(21): Positions 2, 4-5, 8, 10, 12, 14, 16, 18, 20 2'-O-methyl ribonucleotide
gagcgcagcugcuacugguuu

SEQ ID NO: 3122 - DNA, 21 bp, Artificial Sequence
  Synthetic polynucleotide
  modified_base (1)..(21): Positions 1, 3-4, 7, 9, 11, 13, 15, 17, 19, 21 2'-deoxy-2'-fluoro ("2'-fluoro") ribonucleotide
  modified_base (1)..(21): Positions 2, 5-6, 8, 10, 12, 14, 16, 18, 20 2'-O-methyl ribonucleotide
gagcgcagcugcuacugguuu

SEQ ID NO: 3123 - DNA, 21 bp, Artificial Sequence
  Synthetic polynucleotide
  modified_base (1)..(21): Positions 1, 4-5, 7, 9, 11, 13, 15, 17, 19, 21 2'-deoxy-2'-fluoro ("2'-fluoro") ribonucleotide
  modified_base (1)..(21): Positions 2-3, 6, 8, 10, 12, 14, 16, 18, 20 2'-O-methyl ribonucleotide
gagcgcagcugcuacugguuu

SEQ ID NO: 3124 - DNA, 21 bp, Artificial Sequence
  Synthetic polynucleotide
  modified_base (1)..(21): Positions 1-2, 5, 7, 9, 11, 13, 15, 17, 19, 21 2'-deoxy-2'-fluoro ("2'-fluoro") ribonucleotide
  modified_base (1)..(21): Positions 3-4, 6, 8, 10, 12, 14, 16, 18, 20 2'-O-methyl ribonucleotide
gagcgcagcugcuacugguuu

SEQ ID NO: 3125 - DNA, 21 bp, Artificial Sequence
  Synthetic polynucleotide
  modified_base (1)..(21): Positions 2-3, 5, 7, 9, 11, 13, 15, 17, 19, 21 2'-deoxy-2'-fluoro ("2'-fluoro") ribonucleotide
  modified_base (1)..(21): Positions 1, 4, 6, 8, 10, 12, 14, 16, 18, 20 2'-O-methyl ribonucleotide
gagcgcagcugcuacugguuu

SEQ ID NO: 3126 - DNA, 21 bp, Artificial Sequence
  Synthetic polynucleotide
  modified_base (1)..(21): Positions 3, 5, 7, 9, 11, 13, 15, 17, 19, 21 2'-deoxy-2'-fluoro ("2'-fluoro") ribonucleotide
  modified_base (1)..(21): Positions 1-2, 4, 6, 8, 10, 12, 14, 16, 18, 20 2'-O-methyl ribonucleotide
gagcgcagcugcuacugguuu

SEQ ID NO: 3127 - DNA, 21 bp, Artificial Sequence
  Synthetic polynucleotide
  modified_base (1)..(21): Positions 1, 3, 5, 7, 9, 11, 14-15, 17, 19, 21 2'-deoxy-2'-fluoro ("2'-fluoro") ribonucleotide
  modified_base (1)..(21): Positions 2, 4, 6, 8, 10, 12-13, 16, 18, 20 2'-O-methyl ribonucleotide
gagcgcagcugcuacugguuu

SEQ ID NO: 3128 - DNA, 21 bp, Artificial Sequence
  Synthetic polynucleotide
  modified_base (1)..(21): Positions 1, 3, 5, 7, 9, 11, 13-14, 17, 19, 21 2'-deoxy-2'-fluoro ("2'-fluoro") ribonucleotide
  modified_base (1)..(21): Positions 2, 4, 6, 8, 10, 12, 15-16, 18, 20 2'-O-methyl ribonucleotide
gagcgcagcugcuacugguuu

SEQ ID NO: 3129 - DNA, 21 bp, Artificial Sequence
  Synthetic polynucleotide
  modified_base (1)..(21): Positions 1, 3, 5, 7, 9, 11, 13, 16-17, 19, 21 2'-deoxy-2'-fluoro ("2'-fluoro") ribonucleotide
  modified_base (1)..(21): Positions 2, 4, 6, 8, 10, 12, 14-15, 18, 20 2'-O-methyl ribonucleotide
gagcgcagcugcuacugguuu

SEQ ID NO: 3130 - DNA, 21 bp, Artificial Sequence
  Synthetic polynucleotide
  modified_base (1)..(21): Positions 1, 3, 5, 7, 9, 11, 13, 15-16, 19, 21 2'-deoxy-2'-fluoro ("2'-fluoro") ribonucleotide
  modified_base (1)..(21): Positions 2, 4, 6, 8, 10, 12, 14, 17-18, 20 2'-O-methyl ribonucleotide
gagcgcagcugcuacugguuu

SEQ ID NO: 3131 - DNA, 21 bp, Artificial Sequence
  Synthetic polynucleotide
  modified_base (1)..(21): Positions 1, 3, 5, 7, 9, 11, 13, 15, 18-19, 21 2'-deoxy-2'-fluoro ("2'-fluoro") ribonucleotide
  modified_base (1)..(21): Positions 2, 4, 6, 8, 10, 12, 14, 16-17, 20 2'-O-methyl ribonucleotide
gagcgcagcugcuacugguuu

SEQ ID NO: 3132 - DNA, 21 bp, Artificial Sequence
  Synthetic polynucleotide
  modified_base (1)..(21): Positions 1, 3, 5, 7, 9, 11, 13, 15, 17-18, 21 2'-deoxy-2'-fluoro ("2'-fluoro") ribonucleotide
  modified_base (1)..(21): Positions 2, 4, 6, 8, 10, 12, 14, 16, 19-20 2'-O-methyl ribonucleotide
gagcgcagcugcuacugguuu

SEQ ID NO: 3133 - DNA, 21 bp, Artificial Sequence
  Synthetic polynucleotide
  modified_base (1)..(21): Positions 1, 3, 5, 7, 9, 11, 13, 15, 17, 20-21 2'-deoxy-2'-fluoro ("2'-fluoro") ribonucleotide
  modified_base (1)..(21): Positions 2, 4, 6, 8, 10, 12, 14, 16, 18-19 2'-O-methyl ribonucleotide
gagcgcagcugcuacugguuu

SEQ ID NO: 3134 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 1 1-12, 15-16, 19-20 2'-O-methyl ribonucleotide
gagcgcagcugcuacugguuu

SEQ ID NO: 3135 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
gagcgcagcugcuacugguuu

SEQ ID NO: 3136 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
gagcgcagcugcuacugguuu

SEQ ID NO: 3137 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
gagcgcagcugcuacugguuu

SEQ ID NO: 3138 - DNA, 21 bp, Artificial Sequence
  Synthetic polynucleotide
  modified_base (1)..(21): Positions 2-3, 5-7, 9, 11, 14-15, 19 2'-O-methyl ribonucleotide
  modified_base (21)..(21): phosphorothioate linked nucleoside
guugucugugugaucggautt

SEQ ID NO: 3139 - DNA, 21 bp, Artificial Sequence
  Synthetic polynucleotide
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
guugucugugugaucggauuu

SEQ ID NO: 3140 - DNA, 21 bp, Artificial Sequence
  Synthetic polynucleotide
  modified_base (1)..(21): Positions 1, 3, 5, 7-8, 10-11, 13, 15, 17, 19, 21 2'-deoxy-2'-fluoro ("2'-fluoro") ribonucleotide
  modified_base (1)..(21): Positions 2, 4, 6, 9, 12, 14, 16, 18, 20 2'-O-methyl ribonucleotide
guugucugugugaucggauuu

SEQ ID NO: 3141 - DNA, 21 bp, Artificial Sequence
  Synthetic polynucleotide
  modified_base (1)..(21): Positions 1, 3, 5, 7, 10-11, 13, 15, 17, 19, 21 2'-deoxy-2'-fluoro ("2'-fluoro") ribonucleotide
  modified_base (1)..(21): Positions 2, 4, 6, 8-9, 12, 14, 16, 18, 20 2'-O-methyl ribonucleotide
guugucugugugaucggauuu

SEQ ID NO: 3142 - DNA, 21 bp, Artificial Sequence
  Synthetic polynucleotide
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
guugucugugugaucggauuu

SEQ ID NO: 3143 - DNA, 21 bp, Artificial Sequence
  Synthetic polynucleotide
  modified_base (1)..(21): Positions 1, 3, 5, 7, 9-10, 12-13, 15, 17, 19, 21 2'-deoxy-2'-fluoro ("2'-fluoro") ribonucleotide
  modified_base (1)..(21): Positions 2, 4, 6, 8, 11, 14, 16, 18, 20 2'-O-methyl ribonucleotide
guugucugugugaucggauuu

SEQ ID NO: 3144 - DNA, 21 bp, Artificial Sequence
  Synthetic polynucleotide
  modified_base (1)..(21): Positions 1, 3, 5, 7, 9-,10, 13, 15, 17, 19, 21 2'-deoxy-2'-fluoro ("2'-fluoro") ribonucleotide
  modified_base (1)..(21): Positions 2, 4, 6, 8, 11-12, 14, 16, 18, 20 2'-O-methyl ribonucleotide
guugucugugugaucggauuu

SEQ ID NO: 3145 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
guugucugugugaucggauuu

SEQ ID NO: 3146 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
guugucugugugaucggauuu

SEQ ID NO: 3147 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (2)..(3): phosphorothioate linked nucleoside
guugucugugugaucggauuu

SEQ ID NO: 3148 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
guugucugugugaucggauuu

SEQ ID NO: 3149 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
  modified_base (2)..(3): phosphorothioate linked nucleoside
guugucugugugaucggauuu

SEQ ID NO: 3150 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
guugucugugugaucggauuu

SEQ ID NO: 3151 - DNA, 21 bp, Artificial Sequence
  Synthetic polynucleotide
  modified_base (1)..(21): Positions 1, 3, 5-6, 9, 11, 13, 15, 17, 19, 21 2'-deoxy-2'-fluoro ("2'-fluoro") ribonucleotide
  modified_base (1)..(21): Positions 2, 4, 7-8, 10, 12, 14, 16, 18, 20 2'-O-methyl ribonucleotide
guugucugugugaucggauuu

SEQ ID NO: 3152 - DNA, 21 bp, Artificial Sequence
  Synthetic polynucleotide
  modified_base (1)..(21): Positions 1, 3, 6-7, 9, 11, 13, 15, 17, 19, 21 2'-deoxy-2'-fluoro ("2'-fluoro") ribonucleotide
  modified_base (1)..(21): Positions 2, 4-5, 8, 10, 12, 14, 16, 18, 20 2'-O-methyl ribonucleotide
guugucugugugaucggauuu

SEQ ID NO: 3153 - DNA, 21 bp, Artificial Sequence
  Synthetic polynucleotide
  modified_base (1)..(21): Positions 1, 3-4, 7, 9, 11, 13, 15, 17, 19, 21 2'-deoxy-2'-fluoro ("2'-fluoro") ribonucleotide
  modified_base (1)..(21): Positions 2, 5-6, 8, 10, 12, 14, 16, 18, 20 2'-O-methyl ribonucleotide
guugucugugugaucggauuu

SEQ ID NO: 3154 - DNA, 21 bp, Artificial Sequence
  Synthetic polynucleotide
  modified_base (1)..(21): Positions 1, 4-5, 7, 9, 11, 13, 15, 17, 19, 21 2'-deoxy-2'-fluoro ("2'-fluoro") ribonucleotide
  modified_base (1)..(21): Positions 2-3, 6, 8, 10, 12, 14, 16, 18, 20 2'-O-methyl ribonucleotide
guugucugugugaucggauuu

SEQ ID NO: 3155 - DNA, 21 bp, Artificial Sequence
  Synthetic polynucleotide
  modified_base (1)..(21): Positions 1-2, 5, 7, 9, 11, 13, 15, 17, 19, 21 2'-deoxy-2'-fluoro ("2'-fluoro") ribonucleotide
  modified_base (1)..(21): Positions 3-4, 6, 8, 10, 12, 14, 16, 18, 20 2'-O-methyl ribonucleotide
guugucugugugaucggauuu

SEQ ID NO: 3156 - DNA, 21 bp, Artificial Sequence
  Synthetic polynucleotide
  modified_base (1)..(21): Positions 2-3, 5, 7, 9, 11, 13, 15, 17, 19, 21 2'-deoxy-2'-fluoro ("2'-fluoro") ribonucleotide
  modified_base (1)..(21): Positions 1, 4, 6, 8, 10, 12, 14, 16, 18, 20 2'-O-methyl ribonucleotide
guugucugugugaucggauuu

SEQ ID NO: 3157 - DNA, 21 bp, Artificial Sequence
  Synthetic polynucleotide
  modified_base (1)..(21): Positions 3, 5, 7, 9, 11, 13, 15, 17, 19, 21 2'-deoxy-2'-fluoro ("2'-fluoro") ribonucleotide
  modified_base (1)..(21): Positions 1-2, 4, 6, 8, 10, 12, 14, 16, 18, 20 2'-O-methyl ribonucleotide
guugucugugugaucggauuu

SEQ ID NO: 3158 - DNA, 21 bp, Artificial Sequence
  Synthetic polynucleotide
  modified_base (1)..(21): Positions 1, 3, 5, 7, 9, 11, 14-15, 17, 19, 21 2'-deoxy-2'-fluoro ("2'-fluoro") ribonucleotide
  modified_base (1)..(21): Positions 2, 4, 6, 8, 10, 12-13, 16, 18, 20 2'-O-methyl ribonucleotide
guugucugugugaucggauuu

SEQ ID NO: 3159 - DNA, 21 bp, Artificial Sequence
  Synthetic polynucleotide
  modified_base (1)..(21): Positions 1, 3, 5, 7, 9, 11, 13-14, 17, 19, 21 2'-deoxy-2'-fluoro ("2'-fluoro") ribonucleotide
  modified_base (1)..(21): Positions 2, 4, 6, 8, 10, 12, 15-16, 18, 20 2'-O-methyl ribonucleotide
guugucugugugaucggauuu

SEQ ID NO: 3160 - DNA, 21 bp, Artificial Sequence
  Synthetic polynucleotide
  modified_base (1)..(21): Positions 1, 3, 5, 7, 9, 11, 13, 16-17, 19, 21 2'-deoxy-2'-fluoro ("2'-fluoro") ribonucleotide
  modified_base (1)..(21): Positions 2, 4, 6, 8, 10, 12, 14-15, 18, 20 2'-O-methyl ribonucleotide
guugucugugugaucggauuu

SEQ ID NO: 3161 - DNA, 21 bp, Artificial Sequence
  Synthetic polynucleotide
  modified_base (1)..(21): Positions 1, 3, 5, 7, 9, 11, 13, 15-16, 19, 21 2'-deoxy-2'-fluoro ("2'-fluoro") ribonucleotide
  modified_base (1)..(21): Positions 2, 4, 6, 8, 10, 12, 14, 17-18, 20 2'-O-methyl ribonucleotide
guugucugugugaucggauuu

SEQ ID NO: 3162 - DNA, 21 bp, Artificial Sequence
  Synthetic polynucleotide
  modified_base (1)..(21): Positions 1, 3, 5, 7, 9, 11, 13, 15, 18-19, 21 2'-deoxy-2'-fluoro ("2'-fluoro") ribonucleotide
  modified_base (1)..(21): Positions 2, 4, 6, 8, 10, 12, 14, 16-17, 20 2'-O-methyl ribonucleotide
guugucugugugaucggauuu

SEQ ID NO: 3163 - DNA, 21 bp, Artificial Sequence
  Synthetic polynucleotide
  modified_base (1)..(21): Positions 1, 3, 5, 7, 9, 11, 13, 15, 17-18, 21 2'-deoxy-2'-fluoro ("2'-fluoro") ribonucleotide
  modified_base (1)..(21): Positions 2, 4, 6, 8, 10, 12, 14, 16, 19-20 2'-O-methyl ribonucleotide
guugucugugugaucggauuu

SEQ ID NO: 3164 - DNA, 21 bp, Artificial Sequence
  Synthetic polynucleotide
  modified_base (1)..(21): Positions 1, 3, 5, 7, 9, 11, 13, 15, 17, 20-21 2'-deoxy-2'-fluoro ("2'-fluoro") ribonucleotide
  modified_base (1)..(21): Positions 2, 4, 6, 8, 10, 12, 14, 16, 18-19 2'-O-methyl ribonucleotide
guugucugugugaucggauuu

SEQ ID NO: 3165 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
guugucugugugaucggauuu

SEQ ID NO: 3166 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 16, 17-18, 21 2'-O-methyl ribonucleotide
guugucugugugaucggauuu

SEQ ID NO: 3167 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
guugucugugugaucggauuu

SEQ ID NO: 3168 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
guugucugugugaucggauuu

SEQ ID NO: 3169 - DNA, 21 bp, Artificial Sequence
  Synthetic polynucleotide
  modified_base (1)..(21): Positions 5-6, 8, 13-15 2'-O-methyl ribonucleotide
  modified_base (21)..(21): phosphorothioate linked nucleoside
ggagcugcggggccugagatt

SEQ ID NO: 3170 - DNA, 21 bp, Artificial Sequence
  Synthetic polynucleotide
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
ggagcugcggggccugagauu

SEQ ID NO: 3171 - DNA, 21 bp, Artificial Sequence
  Synthetic polynucleotide
  modified_base (1)..(21): Positions 1, 3, 5, 7-8, 10-11, 13, 15, 17, 19, 21 2'-deoxy-2'-fluoro ("2'-fluoro") ribonucleotide
  modified_base (1)..(21): Positions 2, 4, 6, 9, 12, 14, 16, 18, 20 2'-O-methyl ribonucleotide
ggagcugcggggccugagauu

SEQ ID NO: 3172 - DNA, 21 bp, Artificial Sequence
  Synthetic polynucleotide
  modified_base (1)..(21): Positions 1, 3, 5, 7, 10-11, 13, 15, 17, 19, 21 2'-deoxy-2'-fluoro ("2'-fluoro") ribonucleotide
  modified_base (1)..(21): Positions 2, 4, 6, 8-9, 12, 14, 16, 18, 20 2'-O-methyl ribonucleotide
ggagcugcggggccugagauu

SEQ ID NO: 3173 - DNA, 21 bp, Artificial Sequence
  Synthetic polynucleotide
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
ggagcugcggggccugagauu

SEQ ID NO: 3174 - DNA, 21 bp, Artificial Sequence
  Synthetic polynucleotide
  modified_base (1)..(21): Positions 1, 3, 5, 7, 9-10, 12-13, 15, 17, 19, 21 2'-deoxy-2'-fluoro ("2'-fluoro") ribonucleotide
  modified_base (1)..(21): Positions 2, 4, 6, 8, 11, 14, 16, 18, 20 2'-O-methyl ribonucleotide
ggagcugcggggccugagauu

SEQ ID NO: 3175 - DNA, 21 bp, Artificial Sequence
  Synthetic polynucleotide
  modified_base (1)..(21): Positions 1, 3, 5, 7, 9-10, 13, 15, 17, 19, 21 2'-deoxy-2'-fluoro ("2'-fluoro") ribonucleotide
  modified_base (1)..(21): Positions 2, 4, 6, 8, 11-12, 14, 16, 18, 20 2'-O-methyl ribonucleotide
ggagcugcggggccugagauu

SEQ ID NO: 3176 - DNA, 21 bp, Artificial Sequence
  Synthetic polynucleotide
  modified_base (1)..(21): Positions 1, 3, 5, 8- 9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
ggagcugcggggccugagauu

SEQ ID NO: 3177 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
ggagcugcggggccugagauu

SEQ ID NO: 3178 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (2)..(3): phosphorothioate linked nucleoside
ggagcugcggggccugagauu

SEQ ID NO: 3179 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
ggagcugcggggccugagauu

SEQ ID NO: 3180 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
  modified_base (2)..(3): phosphorothioate linked nucleoside
ggagcugcggggccugagauu

SEQ ID NO: 3181 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
ggagcugcggggccugagauu

SEQ ID NO: 3182 - DNA, 21 bp, Artificial Sequence
  Synthetic polynucleotide
  modified_base (1)..(21): Positions 1, 3, 5-6, 9, 11, 13, 15, 17, 19, 21 2'-deoxy-2'-fluoro ("2'-fluoro") ribonucleotide
  modified_base (1)..(21): Positions 2, 4, 7-8, 10, 12, 14, 16, 18, 20 2'-O-methyl ribonucleotide
ggagcugcggggccugagauu

SEQ ID NO: 3183 - DNA, 21 bp, Artificial Sequence
  Synthetic polynucleotide
  modified_base (1)..(21): Positions 1, 3, 6-7, 9, 11, 13, 15, 17, 19, 21 2'-deoxy-2'-fluoro ("2'-fluoro") ribonucleotide
  modified_base (1)..(21): Positions 2, 4-5, 8, 10, 12, 14, 16, 18, 20 2'-O-methyl ribonucleotide
ggagcugcggggccugagauu

SEQ ID NO: 3184 - DNA, 21 bp, Artificial Sequence
  Synthetic polynucleotide
  modified_base (1)..(21): Positions 1, 3-4, 7, 9, 11, 13, 15, 17, 19, 21 2'-deoxy-2'-fluoro ("2'-fluoro") ribonucleotide
  modified_base (1)..(21): Positions 2, 5-6, 8, 10, 12, 14, 16, 18, 20 2'-O-methyl ribonucleotide
ggagcugcggggccugagauu

SEQ ID NO: 3185 - DNA, 21 bp, Artificial Sequence
  Synthetic polynucleotide
  modified_base (1)..(21): Positions 1, 4-5, 7, 9, 11, 13, 15, 17, 19, 21 2'-deoxy-2'-fluoro ("2'-fluoro") ribonucleotide
  modified_base (1)..(21): Positions 2-3, 6, 8, 10, 12, 14, 16, 18, 20 2'-O-methyl ribonucleotide
ggagcugcggggccugagauu

SEQ ID NO: 3186 - DNA, 21 bp, Artificial Sequence
  Synthetic polynucleotide
  modified_base (1)..(21): Positions 1-2, 5, 7, 9, 11, 13, 15, 17, 19, 21 2'-deoxy-2'-fluoro ("2'-fluoro") ribonucleotide
  modified_base (1)..(21): Positions 3-4, 6, 8, 10, 12, 14, 16, 18, 20 2'-O-methyl ribonucleotide
ggagcugcggggccugagauu

SEQ ID NO: 3187 - DNA, 21 bp, Artificial Sequence
  Synthetic polynucleotide
  modified_base (1)..(21): Positions 2-3, 5, 7, 9, 11, 13, 15, 17, 19, 21 2'-deoxy-2'-fluoro ("2'-fluoro") ribonucleotide
  modified_base (1)..(21): Positions 1, 4, 6, 8, 10, 12, 14, 16, 18, 20 2'-O-methyl ribonucleotide
ggagcugcggggccugagauu

SEQ ID NO: 3188 - DNA, 21 bp, Artificial Sequence
  Synthetic polynucleotide
  modified_base (1)..(21): Positions 3, 5, 7, 9, 11, 13, 15, 17, 19, 21 2'-deoxy-2'-fluoro ("2'-fluoro") ribonucleotide
  modified_base (1)..(21): Positions 1-2, 4, 6, 8, 10, 12, 14, 16, 18, 20 2'-O-methyl ribonucleotide
ggagcugcggggccugagauu

SEQ ID NO: 3189 - DNA, 21 bp, Artificial Sequence
  Synthetic polynucleotide
  modified_base (1)..(21): Positions 1, 3, 5, 7, 9, 11, 14-15, 17, 19, 21 2'-deoxy-2'-fluoro ("2'-fluoro") ribonucleotide
  modified_base (1)..(21): Positions 2, 4, 6, 8, 10, 12-13, 16, 18, 20 2'-O-methyl ribonucleotide
ggagcugcggggccugagauu

SEQ ID NO: 3190 - DNA, 21 bp, Artificial Sequence
  Synthetic polynucleotide
  modified_base (1)..(21): Positions 1, 3, 5, 7, 9, 11, 13-14, 17, 19, 21 2'-deoxy-2'-fluoro ("2'-fluoro") ribonucleotide
  modified_base (1)..(21): Positions 2, 4, 6, 8, 10, 12, 15-16, 18, 20 2'-O-methyl ribonucleotide
ggagcugcggggccugagauu

SEQ ID NO: 3191 - DNA, 21 bp, Artificial Sequence
  Synthetic polynucleotide
  modified_base (1)..(21): Positions 1, 3, 5, 7, 9, 11, 13, 16- 17, 19, 21 2'-deoxy-2'-fluoro ("2'-fluoro") ribonucleotide
  modified_base (1)..(21): Positions 2, 4, 6, 8, 10, 12, 14-15, 18, 20 2'-O-methyl ribonucleotide
ggagcugcggggccugagauu

SEQ ID NO: 3192 - DNA, 21 bp, Artificial Sequence
  Synthetic polynucleotide
  modified_base (1)..(21): Positions 1, 3, 5, 7, 9, 11, 13, 15-16, 19, 21 2'-deoxy-2'-fluoro ("2'-fluoro") ribonucleotide
  modified_base (1)..(21): Positions 2, 4, 6, 8, 10, 12, 14, 17-18, 20 2'-O-methyl ribonucleotide
ggagcugcggggccugagauu

SEQ ID NO: 3193 - DNA, 21 bp, Artificial Sequence
  Synthetic polynucleotide
  modified_base (1)..(21): Positions 1, 3, 5, 7, 9, 11, 13, 15, 18-19, 21 2'-deoxy-2'-fluoro ("2'-fluoro") ribonucleotide
  modified_base (1)..(21): Positions 2, 4, 6, 8, 10, 12, 14, 16-17, 20 2'-O-methyl ribonucleotide
ggagcugcggggccugagauu

SEQ ID NO: 3194 - DNA, 21 bp, Artificial Sequence
  Synthetic polynucleotide
  modified_base (1)..(21): Positions 1, 3, 5, 7, 9, 11, 13, 15, 17-18, 21 2'-deoxy-2'-fluoro ("2'-fluoro") ribonucleotide
  modified_base (1)..(21): Positions 2, 4, 6, 8, 10, 12, 14, 16, 19-20 2'-O-methyl ribonucleotide
ggagcugcggggccugagauu

SEQ ID NO: 3195 - DNA, 21 bp, Artificial Sequence
  Synthetic polynucleotide
  modified_base (1)..(21): Positions 1, 3, 5, 7, 9, 11, 13, 15, 17, 20-21 2'-deoxy-2'-fluoro ("2'-fluoro") ribonucleotide
  modified_base (1)..(21): Positions 2, 4, 6, 8, 10, 12, 14, 16, 18-19 2'-O-methyl ribonucleotide
ggagcugcggggccugagauu

SEQ ID NO: 3196 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
ggagcugcggggccugagauu

SEQ ID NO: 3197 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
ggagcugcggggccugagauu

SEQ ID NO: 3198 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
ggagcugcggggccugagauu

SEQ ID NO: 3199 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
ggagcugcggggccugagauu

SEQ ID NO: 3200 - DNA, 21 bp, Artificial Sequence
  Synthetic polynucleotide
  modified_base (1)..(21): Positions 2-3, 5-6, 11, 14, 17, 19 2'-O-methyl ribonucleotide
  modified_base (21)..(21): phosphorothioate linked nucleoside
gccgcuggaacgacgacgutt

SEQ ID NO: 3201 - DNA, 21 bp, Artificial Sequence
  Synthetic polynucleotide
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
gccgcuggaacgacgacguuu

SEQ ID NO: 3202 - DNA, 21 bp, Artificial Sequence
  Synthetic polynucleotide
  modified_base (1)..(21): Positions 1, 3, 5, 7-8, 10-11, 13, 15, 17, 19, 21 2'-deoxy-2'-fluoro ("2'-fluoro") ribonucleotide
  modified_base (1)..(21): Positions 2, 4, 6, 9, 12, 14, 16, 18, 20 2'-O-methyl ribonucleotide
gccgcuggaacgacgacguuu

SEQ ID NO: 3203 - DNA, 21 bp, Artificial Sequence
  Synthetic polynucleotide
  modified_base (1)..(21): Positions 1, 3, 5, 7, 10-11, 13, 15, 17, 19, 21 2'-deoxy-2'-fluoro ("2'-fluoro") ribonucleotide
  modified_base (1)..(21): Positions 2, 4, 6, 8-9, 12, 14, 16, 18, 20 2'-O-methyl ribonucleotide
gccgcuggaacgacgacguuu

SEQ ID NO: 3204 - DNA, 21 bp, Artificial Sequence
  Synthetic polynucleotide
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
gccgcuggaacgacgacguuu

SEQ ID NO: 3205 - DNA, 21 bp, Artificial Sequence
  Synthetic polynucleotide
  modified_base (1)..(21): Positions 1, 3, 5, 7, 9-10, 12-13, 15, 17, 19, 21 2'-deoxy-2'-fluoro ("2'-fluoro") ribonucleotide
  modified_base (1)..(21): Positions 2, 4, 6, 8, 11, 14, 16, 18, 20 2'-O-methyl ribonucleotide
gccgcuggaacgacgacguuu

SEQ ID NO: 3206 - DNA, 21 bp, Artificial Sequence
  Synthetic polynucleotide
  modified_base (1)..(21): Positions 1, 3, 5, 7, 9-10, 13, 15, 17, 19, 21 2'-deoxy-2'-fluoro ("2'-fluoro") ribonucleotide
  modified_base (1)..(21): Positions 2, 4, 6, 8, 11-12, 14, 16, 18, 20 2'-O-methyl ribonucleotide
gccgcuggaacgacgacguuu

SEQ ID NO: 3207 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
gccgcuggaacgacgacguuu

SEQ ID NO: 3208 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
gccgcuggaacgacgacguuu

SEQ ID NO: 3209 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (2)..(3): phosphorothioate linked nucleoside
gccgcuggaacgacgacguuu

SEQ ID NO: 3210 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
gccgcuggaacgacgacguuu

SEQ ID NO: 3211 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
  modified_base (2)..(3): phosphorothioate linked nucleoside
gccgcuggaacgacgacguuu

SEQ ID NO: 3212 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
gccgcuggaacgacgacguuu

SEQ ID NO: 3213 - DNA, 21 bp, Artificial Sequence
  Synthetic polynucleotide
  modified_base (1)..(21): Positions 1, 3, 5-6, 9, 11, 13, 15, 17, 19, 21 2'-deoxy-2'-fluoro ("2'-fluoro") ribonucleotide
  modified_base (1)..(21): Positions 2, 4, 7-8, 10, 12, 14, 16, 18, 20 2'-O-methyl ribonucleotide
gccgcuggaacgacgacguuu

SEQ ID NO: 3214 - DNA, 21 bp, Artificial Sequence
  Synthetic polynucleotide
  modified_base (1)..(21): Positions 1, 3, 6-7, 9, 11, 13, 15, 17, 19, 21 2'-deoxy-2'-fluoro ("2'-fluoro") ribonucleotide
  modified_base (1)..(21): Positions 2, 4-5, 8, 10, 12, 14, 16, 18, 20 2'-O-methyl ribonucleotide
gccgcuggaacgacgacguuu

SEQ ID NO: 3215 - DNA, 21 bp, Artificial Sequence
  Synthetic polynucleotide
  modified_base (1)..(21): Positions 1, 3-4, 7, 9, 11, 13, 15, 17, 19, 21 2'-deoxy-2'-fluoro ("2'-fluoro") ribonucleotide
  modified_base (1)..(21): Positions 2, 5-6, 8, 10, 12, 14, 16, 18, 20 2'-O-methyl ribonucleotide
gccgcuggaacgacgacguuu

SEQ ID NO: 3216 - DNA, 21 bp, Artificial Sequence
  Synthetic polynucleotide
  modified_base (1)..(21): Positions 1, 4- 5, 7, 9, 11, 13, 15, 17, 19, 21 2'-deoxy-2'-fluoro ("2'-fluoro") ribonucleotide
  modified_base (1)..(21): Positions 2-3, 6, 8, 10, 12, 14, 16, 18, 20 2'-O-methyl ribonucleotide
gccgcuggaacgacgacguuu

SEQ ID NO: 3217 - DNA, 21 bp, Artificial Sequence
  Synthetic polynucleotide
  modified_base (1)..(21): Positions 1-2, 5, 7, 9, 11, 13, 15, 17, 19, 21 2'-deoxy-2'-fluoro ("2'-fluoro") ribonucleotide
  modified_base (1)..(21): Positions 3-4, 6, 8, 10, 12, 14, 16, 18, 20 2'-O-methyl ribonucleotide
gccgcuggaacgacgacguuu

SEQ ID NO: 3218 - DNA, 21 bp, Artificial Sequence
  Synthetic polynucleotide
  modified_base (1)..(21): Positions 2-3, 5, 7, 9, 11, 13, 15, 17, 19, 21 2'-deoxy-2'-fluoro ("2'-fluoro") ribonucleotide
  modified_base (1)..(21): Positions 1, 4, 6, 8, 10, 12, 14, 16, 18, 20 2'-O-methyl ribonucleotide
gccgcuggaacgacgacguuu

SEQ ID NO: 3219 - DNA, 21 bp, Artificial Sequence
  Synthetic polynucleotide
  modified_base (1)..(21): Positions 3, 5, 7, 9, 11, 13, 15, 17, 19, 21 2'-deoxy-2'-fluoro ("2'-fluoro") ribonucleotide
  modified_base (1)..(21): Positions 1-2, 4, 6, 8, 10, 12, 14, 16, 18, 20 2'-O-methyl ribonucleotide
gccgcuggaacgacgacguuu

SEQ ID NO: 3220 - DNA, 21 bp, Artificial Sequence
  Synthetic polynucleotide
  modified_base (1)..(21): Positions 1, 3, 5, 7, 9, 11, 14-15, 17, 19, 21 2'-deoxy-2'-fluoro ("2'-fluoro") ribonucleotide
  modified_base (1)..(21): Positions 2, 4, 6, 8, 10, 12-13, 16, 18, 20 2'-O-methyl ribonucleotide
gccgcuggaacgacgacguuu

SEQ ID NO: 3221 - DNA, 21 bp, Artificial Sequence
  Synthetic polynucleotide
  modified_base (1)..(21): Positions 1, 3, 5, 7, 9, 11, 13-14, 17, 19, 21 2'-deoxy-2'-fluoro ("2'-fluoro") ribonucleotide
  modified_base (1)..(21): Positions 2, 4, 6, 8, 10, 12, 15-16, 18, 20 2'-O-methyl ribonucleotide
gccgcuggaacgacgacguuu

SEQ ID NO: 3222 - DNA, 21 bp, Artificial Sequence
  Synthetic polynucleotide
  modified_base (1)..(21): Positions 1, 3, 5, 7, 9, 11, 13, 16-17, 19, 21 2'-deoxy-2'-fluoro ("2'-fluoro") ribonucleotide
  modified_base (1)..(21): Positions 2, 4, 6, 8, 10, 12, 14-15, 18, 20 2'-O-methyl ribonucleotide
gccgcuggaacgacgacguuu

SEQ ID NO: 3223 - DNA, 21 bp, Artificial Sequence
  Synthetic polynucleotide
  modified_base (1)..(21): Positions 1, 3, 5, 7, 9, 11, 13, 15-16, 19, 21 2'-deoxy-2'-fluoro ("2'-fluoro") ribonucleotide
  modified_base (1)..(21): Positions 2, 4, 6, 8, 10, 12, 14, 17-18, 20 2'-O-methyl ribonucleotide
gccgcuggaacgacgacguuu

SEQ ID NO: 3224 - DNA, 21 bp, Artificial Sequence
  Synthetic polynucleotide
  modified_base (1)..(21): Positions 1, 3, 5, 7, 9, 11, 13, 15, 18-19, 21 2'-deoxy-2'-fluoro ("2'-fluoro") ribonucleotide
  modified_base (1)..(21): Positions 2, 4, 6, 8, 10, 12, 14, 16-17, 20 2'-O-methyl ribonucleotide
gccgcuggaacgacgacguuu

SEQ ID NO: 3225 - DNA, 21 bp, Artificial Sequence
  Synthetic polynucleotide
  modified_base (1)..(21): Positions 1, 3, 5, 7, 9, 11, 13, 15, 17-18, 21 2'-deoxy-2'-fluoro ("2'-fluoro") ribonucleotide
  modified_base (1)..(21): Positions 2, 4, 6, 8, 10, 12, 14, 16, 19-20 2'-O-methyl ribonucleotide
gccgcuggaacgacgacguuu

SEQ ID NO: 3226 - DNA, 21 bp, Artificial Sequence
  Synthetic polynucleotide
  modified_base (1)..(21): Positions 1, 3, 5, 7, 9, 11, 13, 15, 17, 20-21 2'-deoxy-2'-fluoro ("2'-fluoro") ribonucleotide
  modified_base (1)..(21): Positions 2, 4, 6, 8, 10, 12, 14, 16, 18-19 2'-O-methyl ribonucleotide
gccgcuggaacgacgacguuu

SEQ ID NO: 3227 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
gccgcuggaacgacgacguuu

SEQ ID NO: 3228 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
gccgcuggaacgacgacguuu

SEQ ID NO: 3229 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
gccgcuggaacgacgacguuu

SEQ ID NO: 3230 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
gccgcuggaacgacgacguuu

SEQ ID NO: 3231 - DNA, 21 bp, Artificial Sequence
  Synthetic polynucleotide
  modified_base (1)..(21): Positions 2, 5-6, 8-9, 11-12, 15-19 2'-O-methyl ribonucleotide
  modified_base (21)..(21): phosphorothioate linked nucleoside
gcagcugcuacugguucuctt

SEQ ID NO: 3232 - DNA, 21 bp, Artificial Sequence
  Synthetic polynucleotide
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
gcagcugcuacugguucucuu

SEQ ID NO: 3233 - DNA, 21 bp, Artificial Sequence
  Synthetic polynucleotide
  modified_base (1)..(21): Positions 1, 3, 5, 7-8, 10-11, 13, 15, 17, 19, 21 2'-deoxy-2'-fluoro ("2'-fluoro") ribonucleotide
  modified_base (1)..(21): Positions 2, 4, 6, 9, 12, 14, 16, 18, 20 2'-O-methyl ribonucleotide
gcagcugcuacugguucucuu

SEQ ID NO: 3234 - DNA, 21 bp, Artificial Sequence
  Synthetic polynucleotide
  modified_base (1)..(21): Positions 1, 3, 5, 7, 10-11, 13, 15, 17, 19, 21 2'-deoxy-2'-fluoro ("2'-fluoro") ribonucleotide
  modified_base (1)..(21): Positions 2, 4, 6, 8-9, 12, 14, 16, 18, 20 2'-O-methyl ribonucleotide
gcagcugcuacugguucucuu

SEQ ID NO: 3235 - DNA, 21 bp, Artificial Sequence
  Synthetic polynucleotide
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
gcagcugcuacugguucucuu

SEQ ID NO: 3236 - DNA, 21 bp, Artificial Sequence
  Synthetic polynucleotide
  modified_base (1)..(21): Positions 1, 3, 5, 7, 9-10, 12-13, 15, 17, 19, 21 2'-deoxy-2'-fluoro ("2'-fluoro") ribonucleotide
  modified_base (1)..(21): Positions 2, 4, 6, 8, 11, 14, 16, 18, 20 2'-O-methyl ribonucleotide
gcagcugcuacugguucucuu

SEQ ID NO: 3237 - DNA, 21 bp, Artificial Sequence
  Synthetic polynucleotide
  modified_base (1)..(21): Positions 1, 3, 5, 7, 9-10, 13, 15, 17, 19, 21 2'-deoxy-2'-fluoro ("2'-fluoro") ribonucleotide
  modified_base (1)..(21): Positions 2, 4, 6, 8, 10-11, 14, 16, 18, 20 2'-O-methyl ribonucleotide
gcagcugcuacugguucucuu

SEQ ID NO: 3238 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
gcagcugcuacugguucucuu

SEQ ID NO: 3239 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
gcagcugcuacugguucucuu

SEQ ID NO: 3240 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (2)..(3): phosphorothioate linked nucleoside
gcagcugcuacugguucucuu

SEQ ID NO: 3241 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
gcagcugcuacugguucucuu

SEQ ID NO: 3242 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
  modified_base (2)..(3): phosphorothioate linked nucleoside
gcagcugcuacugguucucuu

SEQ ID NO: 3243 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
gcagcugcuacugguucucuu

SEQ ID NO: 3244 - DNA, 21 bp, Artificial Sequence
  Synthetic polynucleotide
  modified_base (1)..(21): Positions 1, 3, 5-6, 9, 11, 13, 15, 17, 19, 21 2'-deoxy-2'-fluoro ("2'-fluoro") ribonucleotide
  modified_base (1)..(21): Positions 2, 4, 7-8, 10, 12, 14, 16, 18, 20 2'-O-methyl ribonucleotide
gcagcugcuacugguucucuu

SEQ ID NO: 3245 - DNA, 21 bp, Artificial Sequence
  Synthetic polynucleotide
  modified_base (1)..(21): Positions 1, 3, 6-7, 9, 11, 13, 15, 17, 19, 21 2'-deoxy-2'-fluoro ("2'-fluoro") ribonucleotide
  modified_base (1)..(21): Positions 2, 4-5, 8, 10, 12, 14, 16, 18, 20 2'-O-methyl ribonucleotide
gcagcugcuacugguucucuu

SEQ ID NO: 3246 - DNA, 21 bp, Artificial Sequence
  Synthetic polynucleotide
  modified_base (1)..(21): Positions 1, 3-4, 7, 9, 11, 13, 15, 17, 19, 21 2'-deoxy-2'-fluoro ("2'-fluoro") ribonucleotide
  modified_base (1)..(21): Positions 2, 5- 6, 8, 10, 12, 14, 16, 18, 20 2'-O-methyl ribonucleotide
gcagcugcuacugguucucuu

SEQ ID NO: 3247 - DNA, 21 bp, Artificial Sequence
  Synthetic polynucleotide
  modified_base (1)..(21): Positions 1, 4-5, 7, 9, 11, 13, 15, 17, 19, 21 2'-deoxy-2'-fluoro ("2'-fluoro") ribonucleotide
  modified_base (1)..(21): Positions 2-3, 6, 8, 10, 12, 14, 16, 18, 20 2'-O-methyl ribonucleotide
gcagcugcuacugguucucuu

SEQ ID NO: 3248 - DNA, 21 bp, Artificial Sequence
  Synthetic polynucleotide
  modified_base (1)..(21): Positions 1-2, 5, 7, 9, 11, 13, 15, 17, 19, 21 2'-deoxy-2'-fluoro ("2'-fluoro") ribonucleotide
  modified_base (1)..(21): Positions 3-4, 6, 8, 10, 12, 14, 16, 18, 20 2'-O-methyl ribonucleotide
gcagcugcuacugguucucuu

SEQ ID NO: 3249 - DNA, 21 bp, Artificial Sequence
  Synthetic polynucleotide
  modified_base (1)..(21): Positions 2-3, 5, 7, 9, 11, 13, 15, 17, 19, 21 2'-deoxy-2'-fluoro ("2'-fluoro") ribonucleotide
  modified_base (1)..(21): Positions 1, 4, 6, 8, 10, 12, 14, 16, 18, 20 2'-O-methyl ribonucleotide
gcagcugcuacugguucucuu

SEQ ID NO: 3250 - DNA, 21 bp, Artificial Sequence
  Synthetic polynucleotide
  modified_base (1)..(21): Positions 3, 5, 7, 9, 11, 13, 15, 17, 19, 21 2'-deoxy-2'-fluoro ("2'-fluoro") ribonucleotide
  modified_base (1)..(21): Positions 1-2, 4, 6, 8, 10, 12, 14, 16, 18, 20 2'-O-methyl ribonucleotide
gcagcugcuacugguucucuu

SEQ ID NO: 3251 - DNA, 21 bp, Artificial Sequence
  Synthetic polynucleotide
  modified_base (1)..(21): Positions 1, 3, 5, 7, 9, 11, 14-15, 17, 19, 21 2'-deoxy-2'-fluoro ("2'-fluoro") ribonucleotide
  modified_base (1)..(21): Positions 2, 4, 6, 8, 10, 12-13, 16, 18, 20 2'-O-methyl ribonucleotide
gcagcugcuacugguucucuu

SEQ ID NO: 3252 - DNA, 21 bp, Artificial Sequence
  Synthetic polynucleotide
  modified_base (1)..(21): Positions 1, 3, 5, 7, 9, 11, 13-14, 17, 19, 21 2'-deoxy-2'-fluoro ("2'-fluoro") ribonucleotide
  modified_base (1)..(21): Positions 2, 4, 6, 8, 10, 12, 15-16, 18, 20 2'-O-methyl ribonucleotide
gcagcugcuacugguucucuu

SEQ ID NO: 3253 - DNA, 21 bp, Artificial Sequence
  Synthetic polynucleotide
  modified_base (1)..(21): Positions 1, 3, 5, 7, 9, 11, 13, 16-17, 19, 21 2'-deoxy-2'-fluoro ("2'-fluoro") ribonucleotide
  modified_base (1)..(21): Positions 2, 4, 6, 8, 10, 12, 14-15, 18, 20 2'-O-methyl ribonucleotide
gcagcugcuacugguucucuu

SEQ ID NO: 3254 - DNA, 21 bp, Artificial Sequence
  Synthetic polynucleotide
  modified_base (1)..(21): Positions 1, 3, 5, 7, 9, 11, 13, 15-16, 19, 21 2'-deoxy-2'-fluoro ("2'-fluoro") ribonucleotide
  modified_base (1)..(21): Positions 2, 4, 6, 8, 10, 12, 14, 17-18, 20 2'-O-methyl ribonucleotide
gcagcugcuacugguucucuu

SEQ ID NO: 3255 - DNA, 21 bp, Artificial Sequence
  Synthetic polynucleotide
  modified_base (1)..(21): Positions 1, 3, 5, 7, 9, 11, 13, 15, 18-19, 21 2'-deoxy-2'-fluoro ("2'-fluoro") ribonucleotide
  modified_base (1)..(21): Positions 2, 4, 6, 8, 10, 12, 14, 16-17, 20 2'-O-methyl ribonucleotide
gcagcugcuacugguucucuu

SEQ ID NO: 3256 - DNA, 21 bp, Artificial Sequence
  Synthetic polynucleotide
  modified_base (1)..(21): Positions 1, 3, 5, 7, 9, 11, 13, 15, 17-18, 21 2'-deoxy-2'-fluoro ("2'-fluoro") ribonucleotide
  modified_base (1)..(21): Positions 2, 4, 6, 8, 10, 12, 14, 16, 19-20 2'-O-methyl ribonucleotide
gcagcugcuacugguucucuu

SEQ ID NO: 3257 - DNA, 21 bp, Artificial Sequence
  Synthetic polynucleotide
  modified_base (1)..(21): Positions 1, 3, 5, 7, 9, 11, 13, 15, 17, 20-21 2'-deoxy-2'-fluoro ("2'-fluoro") ribonucleotide
  modified_base (1)..(21): Positions 2, 4, 6, 8, 10, 12, 14, 16, 18-19 2'-O-methyl ribonucleotide
gcagcugcuacugguucucuu

SEQ ID NO: 3258 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
gcagcugcuacugguucucuu

SEQ ID NO: 3259 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
gcagcugcuacugguucucuu

SEQ ID NO: 3260 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
gcagcugcuacugguucucuu

SEQ ID NO: 3261 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
gcagcugcuacugguucucuu

SEQ ID NO: 3262 - DNA, 21 bp, Artificial Sequence
  Synthetic polynucleotide
  modified_base (1)..(21): Positions 2-3, 7-9, 11, 16 2'-O-methyl ribonucleotide
  modified_base (21)..(21): phosphorothioate linked nucleoside
gcugggucugcgagacagatt

SEQ ID NO: 3263 - DNA, 21 bp, Artificial Sequence
  Synthetic polynucleotide
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
gcugggucugcgagacagauu

SEQ ID NO: 3264 - DNA, 21 bp, Artificial Sequence
  Synthetic polynucleotide
  modified_base (1)..(21): Positions 1, 3, 5, 7-8, 10-11, 13, 15, 17, 19, 21 2'-deoxy-2'-fluoro ("2'-fluoro") ribonucleotide
  modified_base (1)..(21): Positions 2, 4, 6, 9, 12, 14, 16, 18, 20 2'-O-methyl ribonucleotide
gcugggucugcgagacagauu

SEQ ID NO: 3265 - DNA, 21 bp, Artificial Sequence
  Synthetic polynucleotide
  modified_base (1)..(21): Positions 1, 3, 5, 7, 10-11, 13, 15, 17, 19, 21 2'-deoxy-2'-fluoro ("2'-fluoro") ribonucleotide
  modified_base (1)..(21): Positions 2, 4, 6, 8-9, 12, 14, 16, 18, 20 2'-O-methyl ribonucleotide
gcugggucugcgagacagauu

SEQ ID NO: 3266 - DNA, 21 bp, Artificial Sequence
  Synthetic polynucleotide
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
gcugggucugcgagacagauu

SEQ ID NO: 3267 - DNA, 21 bp, Artificial Sequence
  Synthetic polynucleotide
  modified_base (1)..(21): Positions 1, 3, 5, 7, 9-10, 12-13, 15, 17, 19, 21 2'-deoxy-2'-fluoro ("2'-fluoro") ribonucleotide
  modified_base (1)..(21): Positions 2, 4, 6, 8, 11, 14, 16, 18, 20 2'-O-methyl ribonucleotide
gcugggucugcgagacagauu

SEQ ID NO: 3268 - DNA, 21 bp, Artificial Sequence
  Synthetic polynucleotide
  modified_base (1)..(21): Positions 1, 3, 5, 7, 9-10, 13, 15, 17, 19, 21 2'-deoxy-2'-fluoro ("2'-fluoro") ribonucleotide
  modified_base (1)..(21): Positions 2, 4, 6, 8, 11-12, 14, 16, 18, 20 2'-O-methyl ribonucleotide
gcugggucugcgagacagauu

SEQ ID NO: 3269 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
gcugggucugcgagacagauu

SEQ ID NO: 3270 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
gcugggucugcgagacagauu

SEQ ID NO: 3271 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (2)..(3): phosphorothioate linked nucleoside
gcugggucugcgagacagauu

SEQ ID NO: 3272 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
gcugggucugcgagacagauu

SEQ ID NO: 3273 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
  modified_base (2)..(3): phosphorothioate linked nucleoside
gcugggucugcgagacagauu

SEQ ID NO: 3274 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
gcugggucugcgagacagauu

SEQ ID NO: 3275 - DNA, 21 bp, Artificial Sequence
  Synthetic polynucleotide
  modified_base (1)..(21): Positions 1, 3, 5-6, 9, 11, 13, 15, 17, 19, 21 2'-deoxy-2'-fluoro ("2'-fluoro") ribonucleotide
  modified_base (1)..(21): Positions 2, 4, 7-8, 10, 12, 14, 16, 18, 20 2'-O-methyl ribonucleotide
gcugggucugcgagacagauu

SEQ ID NO: 3276 - DNA, 21 bp, Artificial Sequence
  Synthetic polynucleotide
  modified_base (1)..(21): Positions 1, 3, 6-7, 9, 11, 13, 15, 17, 19, 21 2'-deoxy-2'-fluoro ("2'-fluoro") ribonucleotide
  modified_base (1)..(21): Positions 2, 4-5, 8, 10, 12, 14, 16, 18, 20 2'-O-methyl ribonucleotide
gcugggucugcgagacagauu

SEQ ID NO: 3277 - DNA, 21 bp, Artificial Sequence
  Synthetic polynucleotide
  modified_base (1)..(21): Positions 1, 3-4, 7, 9, 11, 13, 15, 17, 19, 21 2'-deoxy-2'-fluoro ("2'-fluoro") ribonucleotide
  modified_base (1)..(21): Positions 2, 5-6, 8, 10, 12, 14, 16, 18, 20 2'-O-methyl ribonucleotide
gcugggucugcgagacagauu

SEQ ID NO: 3278 - DNA, 21 bp, Artificial Sequence
  Synthetic polynucleotide
  modified_base (1)..(21): Positions 1, 4-5, 7, 9, 11, 13, 15, 17, 19, 21 2'-deoxy-2'-fluoro ("2'-fluoro") ribonucleotide
  modified_base (1)..(21): Positions 2-3, 6, 8, 10, 12, 14, 16, 18, 20 2'-O-methyl ribonucleotide
gcugggucugcgagacagauu

SEQ ID NO: 3279 - DNA, 21 bp, Artificial Sequence
  Synthetic polynucleotide
  modified_base (1)..(21): Positions 1-2, 5, 7, 9, 11, 13, 15, 17, 19, 21 2'-deoxy-2'-fluoro ("2'-fluoro") ribonucleotide
  modified_base (1)..(21): Positions 3-4, 6, 8, 10, 12, 14, 16, 18, 20 2'-O-methyl ribonucleotide
gcugggucugcgagacagauu

SEQ ID NO: 3280 - DNA, 21 bp, Artificial Sequence
  Synthetic polynucleotide
  modified_base (1)..(21): Positions 2-3, 5, 7, 9, 11, 13, 15, 17, 19, 21 2'-deoxy-2'-fluoro ("2'-fluoro") ribonucleotide
  modified_base (1)..(21): Positions 1, 4, 6, 8, 10, 12, 14, 16, 18, 20 2'-O-methyl ribonucleotide
gcugggucugcgagacagauu

SEQ ID NO: 3281 - DNA, 21 bp, Artificial Sequence
  Synthetic polynucleotide
  modified_base (1)..(21): Positions 3, 5, 7, 9, 11, 13, 15, 17, 19, 21 2'-deoxy-2'-fluoro ("2'-fluoro") ribonucleotide
  modified_base (1)..(21): Positions 1-2, 4, 6, 8, 10, 12, 14, 16, 18, 20 2'-O-methyl ribonucleotide
gcugggucugcgagacagauu

SEQ ID NO: 3282 - DNA, 21 bp, Artificial Sequence
  Synthetic polynucleotide
  modified_base (1)..(21): Positions 1, 3, 5, 7, 9, 11, 14-15, 17, 19, 21 2'-deoxy-2'-fluoro ("2'-fluoro") ribonucleotide
  modified_base (1)..(21): Positions 2, 4, 6, 8, 10, 12-13, 16, 18, 20 2'-O-methyl ribonucleotide
gcugggucugcgagacagauu

SEQ ID NO: 3283 - DNA, 21 bp, Artificial Sequence
  Synthetic polynucleotide
  modified_base (1)..(21): Positions 1, 3, 5, 7, 9, 11, 13-14, 17, 19, 21 2'-deoxy-2'-fluoro ("2'-fluoro") ribonucleotide
  modified_base (1)..(21): Positions 2, 4, 6, 8, 10, 12, 15-16, 18, 20 2'-O-methyl ribonucleotide
gcugggucugcgagacagauu

SEQ ID NO: 3284 - DNA, 21 bp, Artificial Sequence
  Synthetic polynucleotide
  modified_base (1)..(21): Positions 1, 3, 5, 7, 9, 11, 13, 16-17, 19, 21 2'-deoxy-2'-fluoro ("2'-fluoro") ribonucleotide
  modified_base (1)..(21): Positions 2, 4, 6, 8, 10, 12, 14-15, 18, 20 2'-O-methyl ribonucleotide
gcugggucugcgagacagauu

SEQ ID NO: 3285 - DNA, 21 bp, Artificial Sequence
  Synthetic polynucleotide
  modified_base (1)..(21): Positions 1, 3, 5, 7, 9, 11, 13, 15-16, 19, 21 2'-deoxy-2'-fluoro ("2'-fluoro") ribonucleotide
  modified_base (1)..(21): Positions 2, 4, 6, 8, 10, 12, 14, 17-18, 20 2'-O-methyl ribonucleotide
gcugggucugcgagacagauu

SEQ ID NO: 3286 - DNA, 21 bp, Artificial Sequence
  Synthetic polynucleotide
  modified_base (1)..(21): Positions 1, 3, 5, 7, 9, 11, 13, 15, 18-19, 21 2'-deoxy-2'-fluoro ("2'-fluoro") ribonucleotide
  modified_base (1)..(21): Positions 2, 4, 6, 8, 10, 12, 14, 16-17, 20 2'-O-methyl ribonucleotide
gcugggucugcgagacagauu

SEQ ID NO: 3287 - DNA, 21 bp, Artificial Sequence
  Synthetic polynucleotide
  modified_base (1)..(21): Positions 1, 3, 5, 7, 9, 11, 13, 15, 17-18, 21 2'-deoxy-2'-fluoro ("2'-fluoro") ribonucleotide
  modified_base (1)..(21): Positions 2, 4, 6, 8, 10, 12, 14, 16, 19-20 2'-O-methyl ribonucleotide
gcugggucugcgagacagauu

SEQ ID NO: 3288 - DNA, 21 bp, Artificial Sequence
  Synthetic polynucleotide
  modified_base (1)..(21): Positions 1, 3, 5, 7, 9, 11, 13, 15, 17, 20-21 2'-deoxy-2'-fluoro ("2'-fluoro") ribonucleotide
  modified_base (1)..(21): Positions 2, 4, 6, 8, 10, 12, 14, 16, 17-18 2'-O-methyl ribonucleotide
gcugggucugcgagacagauu

SEQ ID NO: 3289 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
gcugggucugcgagacagauu

SEQ ID NO: 3290 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
gcugggucugcgagacagauu

SEQ ID NO: 3291 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
gcugggucugcgagacagauu

SEQ ID NO: 3292 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
gcugggucugcgagacagauu

SEQ ID NO: 3293 - DNA, 21 bp, Artificial Sequence
  Synthetic polynucleotide
  modified_base (1)..(21): Positions 2-8, 10, 12, 14-18 2'-O-methyl ribonucleotide
  modified_base (21)..(21): phosphorothioate linked nucleoside
gcuuucucgggaauuuucatt

SEQ ID NO: 3294 - DNA, 21 bp, Artificial Sequence
  Synthetic polynucleotide
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
gcuuucucgggaauuuucauu

SEQ ID NO: 3295 - DNA, 21 bp, Artificial Sequence
  Synthetic polynucleotide
  modified_base (1)..(21): Positions 1, 3, 5, 7-8, 10-11, 13, 15, 17, 19, 21 2'-deoxy-2'-fluoro ("2'-fluoro") ribonucleotide
  modified_base (1)..(21): Positions 2, 4, 6, 9, 12, 14, 16, 18, 20 2'-O-methyl ribonucleotide
gcuuucucgggaauuuucauu

SEQ ID NO: 3296 - DNA, 21 bp, Artificial Sequence
  Synthetic polynucleotide
  modified_base (1)..(21): Positions 1, 3, 5, 7, 10-11, 13, 15, 17, 19, 21 2'-deoxy-2'-fluoro ("2'-fluoro") ribonucleotide
  modified_base (1)..(21): Positions 2, 4, 6, 8-9, 12, 14, 16, 18, 20 2'-O-methyl ribonucleotide
gcuuucucgggaauuuucauu

SEQ ID NO: 3297 - DNA, 21 bp, Artificial Sequence
  Synthetic polynucleotide
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
gcuuucucgggaauuuucauu

SEQ ID NO: 3298 - DNA, 21 bp, Artificial Sequence
  Synthetic polynucleotide
  modified_base (1)..(21): Positions 1, 3, 5, 7, 9-10, 12-13, 15, 17, 19, 21 2'-deoxy-2'-fluoro ("2'-fluoro") ribonucleotide
  modified_base (1)..(21): Positions 2, 4, 6, 8, 11, 14, 16, 18, 20 2'-O-methyl ribonucleotide
gcuuucucgggaauuuucauu

SEQ ID NO: 3299 - DNA, 21 bp, Artificial Sequence
  Synthetic polynucleotide
  modified_base (1)..(21): Positions 1, 3, 5, 7, 9-10, 13, 15, 17, 19, 21 2'-deoxy-2'-fluoro ("2'-fluoro") ribonucleotide
  modified_base (1)..(21): Positions 2, 4, 6, 8, 11-12, 14, 16, 18, 20 2'-O-methyl ribonucleotide
gcuuucucgggaauuuucauu

SEQ ID NO: 3300 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
gcuuucucgggaauuuucauu

SEQ ID NO: 3301 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
gcuuucucgggaauuuucauu

SEQ ID NO: 3302 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (2)..(3): phosphorothioate linked nucleoside
gcuuucucgggaauuuucauu

SEQ ID NO: 3303 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
gcuuucucgggaauuuucauu

SEQ ID NO: 3304 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
  modified_base (2)..(3): phosphorothioate linked nucleoside
gcuuucucgggaauuuucauu

SEQ ID NO: 3305 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
gcuuucucgggaauuuucauu

SEQ ID NO: 3306 - DNA, 21 bp, Artificial Sequence
  Synthetic polynucleotide
  modified_base (1)..(21): Positions 1, 3, 5-6, 9, 11, 13, 15, 17, 19, 21 2'-deoxy-2'-fluoro ("2'-fluoro") ribonucleotide
  modified_base (1)..(21): Positions 2, 4, 7-8, 10, 12, 14, 16, 18, 20 2'-O-methyl ribonucleotide
gcuuucucgggaauuuucauu

SEQ ID NO: 3307 - DNA, 21 bp, Artificial Sequence
  Synthetic polynucleotide
  modified_base (1)..(21): Positions 1, 3, 6-7, 9, 11, 13, 15, 17, 19, 21 2'-deoxy-2'-fluoro ("2'-fluoro") ribonucleotide
  modified_base (1)..(21): Positions 2, 4-5, 8, 10, 12, 14, 16, 18, 20 2'-O-methyl ribonucleotide
gcuuucucgggaauuuucauu

SEQ ID NO: 3308 - DNA, 21 bp, Artificial Sequence
  Synthetic polynucleotide
  modified_base (1)..(21): Positions 1, 3-4, 7, 9, 11, 13, 15, 17, 19, 21 2'-deoxy-2'-fluoro ("2'-fluoro") ribonucleotide
  modified_base (1)..(21): Positions 2, 5-6, 8, 10, 12, 14, 16, 18, 20 2'-O-methyl ribonucleotide
gcuuucucgggaauuuucauu

SEQ ID NO: 3309 - DNA, 21 bp, Artificial Sequence
  Synthetic polynucleotide
  modified_base (1)..(21): Positions 1, 4-5, 7, 9, 11, 13, 15, 17, 19, 21 2'-deoxy-2'-fluoro ("2'-fluoro") ribonucleotide
  modified_base (1)..(21): Positions 2-3, 6, 8, 10, 12, 14, 16, 18, 20 2'-O-methyl ribonucleotide
gcuuucucgggaauuuucauu

SEQ ID NO: 3310 - DNA, 21 bp, Artificial Sequence
  Synthetic polynucleotide
  modified_base (1)..(21): Positions 1-2, 5, 7, 9, 11, 13, 15, 17, 19, 21 2'-deoxy-2'-fluoro ("2'-fluoro") ribonucleotide
  modified_base (1)..(21): Positions 3-4, 6, 8, 10, 12, 14, 16, 18, 20 2'-O-methyl ribonucleotide
gcuuucucgggaauuuucauu

SEQ ID NO: 3311 - DNA, 21 bp, Artificial Sequence
  Synthetic polynucleotide
  modified_base (1)..(21): Positions 2-3, 5, 7, 9, 11, 13, 15, 17, 19, 21 2'-deoxy-2'-fluoro ("2'-fluoro") ribonucleotide
  modified_base (1)..(21): Positions 1, 4, 6, 8, 10, 12, 14, 16, 18, 20 2'-O-methyl ribonucleotide
gcuuucucgggaauuuucauu

SEQ ID NO: 3312 - DNA, 21 bp, Artificial Sequence
  Synthetic polynucleotide
  modified_base (1)..(21): Positions 3, 5, 7, 9, 11, 13, 15, 17, 19, 21 2'-deoxy-2'-fluoro ("2'-fluoro") ribonucleotide
  modified_base (1)..(21): Positions 1-2, 4, 6, 8, 10, 12, 14, 16, 18, 20 2'-O-methyl ribonucleotide
gcuuucucgggaauuuucauu

SEQ ID NO: 3313 - DNA, 21 bp, Artificial Sequence
  Synthetic polynucleotide
  modified_base (1)..(21): Positions 1, 3, 5, 7, 9, 11, 14-15, 17, 19, 21 2'-deoxy-2'-fluoro ("2'-fluoro") ribonucleotide
  modified_base (1)..(21): Positions 2, 4, 6, 8, 10, 12-13, 16, 18, 20 2'-O-methyl ribonucleotide
gcuuucucgggaauuuucauu

SEQ ID NO: 3314 - DNA, 21 bp, Artificial Sequence
  Synthetic polynucleotide
  modified_base (1)..(21): Positions 1, 3, 5, 7, 9, 11, 13-14, 17, 19, 21 2'-deoxy-2'-fluoro ("2'-fluoro") ribonucleotide
  modified_base (1)..(21): Positions 2, 4, 6, 8, 10, 12, 15-16, 18, 20 2'-O-methyl ribonucleotide
gcuuucucgggaauuuucauu

SEQ ID NO: 3315 - DNA, 21 bp, Artificial Sequence
  Synthetic polynucleotide
  modified_base (1)..(21): Positions 1, 3, 5, 7, 9, 11, 13, 16-17, 19, 21 2'-deoxy-2'-fluoro ("2'-fluoro") ribonucleotide
  modified_base (1)..(21): Positions 2, 4, 6, 8, 10, 12, 14-15, 18, 20 2'-O-methyl ribonucleotide
gcuuucucgggaauuuucauu

SEQ ID NO: 3316 - DNA, 21 bp, Artificial Sequence
  Synthetic polynucleotide
  modified_base (1)..(21): Positions 1, 3, 5, 7, 9, 11, 13, 15-16, 19, 21 2'-deoxy-2'-fluoro ("2'-fluoro") ribonucleotide
  modified_base (1)..(21): Positions 2, 4, 6, 8, 10, 12, 14, 17-18, 20 2'-O-methyl ribonucleotide
gcuuucucgggaauuuucauu

SEQ ID NO: 3317 - DNA, 21 bp, Artificial Sequence
  Synthetic polynucleotide
  modified_base (1)..(21): Positions 1, 3, 5, 7, 9, 11, 13, 15, 18-19, 21 2'-deoxy-2'-fluoro ("2'-fluoro") ribonucleotide
  modified_base (1)..(21): Positions 2, 4, 6, 8, 10, 12, 14, 16-17, 20 2'-O-methyl ribonucleotide
gcuuucucgggaauuuucauu

SEQ ID NO: 3318 - DNA, 21 bp, Artificial Sequence
  Synthetic polynucleotide
  modified_base (1)..(21): Positions 1, 3, 5, 7, 9, 11, 13, 15, 17-18, 21 2'-deoxy-2'-fluoro ("2'-fluoro") ribonucleotide
  modified_base (1)..(21): Positions 2, 4, 6, 8, 10, 12, 14, 16, 19-20 2'-O-methyl ribonucleotide
gcuuucucgggaauuuucauu

SEQ ID NO: 3319 - DNA, 21 bp, Artificial Sequence
  Synthetic polynucleotide
  modified_base (1)..(21): Positions 1, 3, 5, 7, 9, 11, 13, 15, 17, 20-21 2'-deoxy-2'-fluoro ("2'-fluoro") ribonucleotide
  modified_base (1)..(21): Positions 2, 4, 6, 8, 10, 12, 14, 16, 18-19 2'-O-methyl ribonucleotide
gcuuucucgggaauuuucauu

SEQ ID NO: 3320 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
gcuuucucgggaauuuucauu

SEQ ID NO: 3321 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
gcuuucucgggaauuuucauu

SEQ ID NO: 3322 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
gcuuucucgggaauuuucauu

SEQ ID NO: 3323 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
gcuuucucgggaauuuucauu

SEQ ID NO: 3324 - DNA, 21 bp, Artificial Sequence
  Synthetic polynucleotide
  modified_base (1)..(21): Positions 1-6, 8-9, 11-13, 15, 18-19 2'-O-methyl ribonucleotide
  modified_base (21)..(21): phosphorothioate linked nucleoside
ccuccugcugcuugugguutt

SEQ ID NO: 3325 - DNA, 21 bp, Artificial Sequence
  Synthetic polynucleotide
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
ccuccugcugcuugugguuuu

SEQ ID NO: 3326 - DNA, 21 bp, Artificial Sequence
  Synthetic polynucleotide
  modified_base (1)..(21): Positions 1, 3, 5, 7-8, 10-11, 13, 15, 17, 19, 21 2'-deoxy-2'-fluoro ("2'-fluoro") ribonucleotide
  modified_base (1)..(21): Positions 2, 4, 6, 9, 12, 14, 16, 18, 20 2'-O-methyl ribonucleotide
ccuccugcugcuugugguuuu

SEQ ID NO: 3327 - DNA, 21 bp, Artificial Sequence
  Synthetic polynucleotide
  modified_base (1)..(21): Positions 1, 3, 5, 7, 10-11, 13, 15, 17, 19, 21 2'-deoxy-2'-fluoro ("2'-fluoro") ribonucleotide
  modified_base (1)..(21): Positions 2, 4, 6, 8-9, 12, 14, 16, 18, 20 2'-O-methyl ribonucleotide
ccuccugcugcuugugguuuu

SEQ ID NO: 3328 - DNA, 21 bp, Artificial Sequence
  Synthetic polynucleotide
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
ccuccugcugcuugugguuuu

SEQ ID NO: 3329 - DNA, 21 bp, Artificial Sequence
  Synthetic polynucleotide
  modified_base (1)..(21): Positions 1, 3, 5, 7, 9-10, 12-13, 15, 17, 19, 21 2'-deoxy-2'-fluoro ("2'-fluoro") ribonucleotide
  modified_base (1)..(21): Positions 2, 4, 6, 8, 11, 14, 16, 18, 20 2'-O-methyl ribonucleotide
ccuccugcugcuugugguuuu

SEQ ID NO: 3330 - DNA, 21 bp, Artificial Sequence
  Synthetic polynucleotide
  modified_base (1)..(21): Positions 1, 3, 5, 7, 9-10, 13, 15, 17, 19, 21 2'-deoxy-2'-fluoro ("2'-fluoro") ribonucleotide
  modified_base (1)..(21): Positions 2, 4, 6, 8, 11-12, 14, 16, 18, 20 2'-O-methyl ribonucleotide
ccuccugcugcuugugguuuu

SEQ ID NO: 3331 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
ccuccugcugcuugugguuuu

SEQ ID NO: 3332 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
ccuccugcugcuugugguuuu

SEQ ID NO: 3333 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (2)..(3): phosphorothioate linked nucleoside
ccuccugcugcuugugguuuu

SEQ ID NO: 3334 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
ccuccugcugcuugugguuuu

SEQ ID NO: 3335 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
  modified_base (2)..(3): phosphorothioate linked nucleoside
ccuccugcugcuugugguuuu

SEQ ID NO: 3336 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
ccuccugcugcuugugguuuu

SEQ ID NO: 3337 - DNA, 21 bp, Artificial Sequence
  Synthetic polynucleotide
  modified_base (1)..(21): Positions 1, 3, 5-6, 9, 11, 13, 15, 17, 19, 21 2'-deoxy-2'-fluoro ("2'-fluoro") ribonucleotide
  modified_base (1)..(21): Positions 2, 4, 7-8, 10, 12, 14, 16, 18, 20 2'-O-methyl ribonucleotide
ccuccugcugcuugugguuuu

SEQ ID NO: 3338 - DNA, 21 bp, Artificial Sequence
  Synthetic polynucleotide
  modified_base (1)..(21): Positions 1, 3, 6-7, 9, 11, 13, 15, 17, 19, 21 2'-deoxy-2'-fluoro ("2'-fluoro") ribonucleotide
  modified_base (1)..(21): Positions 2, 4-5, 8, 10, 12, 14, 16, 18, 20 2'-O-methyl ribonucleotide
ccuccugcugcuugugguuuu

SEQ ID NO: 3339 - DNA, 21 bp, Artificial Sequence
  Synthetic polynucleotide
  modified_base (1)..(21): Positions 1, 3-4, 7, 9, 11, 13, 15, 17, 19, 21 2'-deoxy-2'-fluoro ("2'-fluoro") ribonucleotide
  modified_base (1)..(21): Positions 2, 5-6, 8, 10, 12, 14, 16, 18, 20 2'-O-methyl ribonucleotide
ccuccugcugcuugugguuuu

SEQ ID NO: 3340 - DNA, 21 bp, Artificial Sequence
  Synthetic polynucleotide
  modified_base (1)..(21): Positions 1, 4-5, 7, 9, 11, 13, 15, 17, 19, 21 2'-deoxy-2'-fluoro ("2'-fluoro") ribonucleotide
  modified_base (1)..(21): Positions 2-3, 6, 8, 10, 12, 14, 16, 18, 20 2'-O-methyl ribonucleotide
ccuccugcugcuugugguuuu

SEQ ID NO: 3341 - DNA, 21 bp, Artificial Sequence
  Synthetic polynucleotide
  modified_base (1)..(21): Positions 1-2, 5, 7, 9, 11, 13, 15, 17, 19, 21 2'-deoxy-2'-fluoro ("2'-fluoro") ribonucleotide
  modified_base (1)..(21): Positions 3-4, 6, 8, 10, 12, 14, 16, 18, 20 2'-O-methyl ribonucleotide
ccuccugcugcuugugguuuu

SEQ ID NO: 3342 - DNA, 21 bp, Artificial Sequence
  Synthetic polynucleotide
  modified_base (1)..(21): Positions 2-3, 5, 7, 9, 11, 13, 15, 17, 19, 21 2'-deoxy-2'-fluoro ("2'-fluoro") ribonucleotide
  modified_base (1)..(21): Positions 1, 4, 6, 8, 10, 12, 14, 16, 18, 20 2'-O-methyl ribonucleotide
ccuccugcugcuugugguuuu

SEQ ID NO: 3343 - DNA, 21 bp, Artificial Sequence
  Synthetic polynucleotide
  modified_base (1)..(21): Positions 3, 5, 7, 9, 11, 13, 15, 17, 19, 21 2'-deoxy-2'-fluoro ("2'-fluoro") ribonucleotide
  modified_base (1)..(21): Positions 1-2, 4, 6, 8, 10, 12, 14, 16, 18, 20 2'-O-methyl ribonucleotide
ccuccugcugcuugugguuuu

SEQ ID NO: 3344 - DNA, 21 bp, Artificial Sequence
  Synthetic polynucleotide
  modified_base (1)..(21): Positions 1, 3, 5, 7, 9, 11, 14-15, 17, 19, 21 2'-deoxy-2'-fluoro ("2'-fluoro") ribonucleotide
  modified_base (1)..(21): Positions 2, 4, 6, 8, 10, 12-13, 16, 18, 20 2'-O-methyl ribonucleotide
ccuccugcugcuugugguuuu

SEQ ID NO: 3345 - DNA, 21 bp, Artificial Sequence
  Synthetic polynucleotide
  modified_base (1)..(21): Positions 1, 3, 5, 7, 9, 11, 13-14, 17, 19, 21 2'-deoxy-2'-fluoro ("2'-fluoro") ribonucleotide
  modified_base (1)..(21): Positions 2, 4, 6, 8, 10, 12, 15-16, 18, 20 2'-O-methyl ribonucleotide
ccuccugcugcuugugguuuu

SEQ ID NO: 3346 - DNA, 21 bp, Artificial Sequence
  Synthetic polynucleotide
  modified_base (1)..(21): Positions 1, 3, 5, 7, 9, 11, 13, 16-17, 19, 21 2'-deoxy-2'-fluoro ("2'-fluoro") ribonucleotide
  modified_base (1)..(21): Positions 2, 4, 6, 8, 10, 12, 14-15, 18, 20 2'-O-methyl ribonucleotide
ccuccugcugcuugugguuuu

SEQ ID NO: 3347 - DNA, 21 bp, Artificial Sequence
  Synthetic polynucleotide
  modified_base (1)..(21): Positions 1, 3, 5, 7, 9, 11, 13, 15-16, 19, 21 2'-deoxy-2'-fluoro ("2'-fluoro") ribonucleotide
  modified_base (1)..(21): Positions 2, 4, 6, 8, 10, 12, 14, 17-18, 20 2'-O-methyl ribonucleotide
ccuccugcugcuugugguuuu

SEQ ID NO: 3348 - DNA, 21 bp, Artificial Sequence
  Synthetic polynucleotide
  modified_base (1)..(21): Positions 1, 3, 5, 7, 9, 11, 13, 15, 18-19, 21 2'-deoxy-2'-fluoro ("2'-fluoro") ribonucleotide
  modified_base (1)..(21): Positions 2, 4, 6, 8, 10, 12, 14, 16-17, 20 2'-O-methyl ribonucleotide
ccuccugcugcuugugguuuu

SEQ ID NO: 3349 - DNA, 21 bp, Artificial Sequence
  Synthetic polynucleotide
  modified_base (1)..(21): Positions 1, 3, 5, 7, 9, 11, 13, 15, 17-18, 21 2'-deoxy-2'-fluoro ("2'-fluoro") ribonucleotide
  modified_base (1)..(21): Positions 2, 4, 6, 8, 10, 12, 14, 16, 19-20 2'-O-methyl ribonucleotide
ccuccugcugcuugugguuuu

SEQ ID NO: 3350 - DNA, 21 bp, Artificial Sequence
  Synthetic polynucleotide
  modified_base (1)..(21): Positions 1, 3, 5, 7, 9, 11, 13, 15, 17, 20-21 2'-deoxy-2'-fluoro ("2'-fluoro") ribonucleotide
  modified_base (1)..(21): Positions 2, 4, 6, 8, 10, 12, 14, 16, 18-19 2'-O-methyl ribonucleotide
ccuccugcugcuugugguuuu

SEQ ID NO: 3351 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
ccuccugcugcuugugguuuu

SEQ ID NO: 3352 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
ccuccugcugcuugugguuuu

SEQ ID NO: 3353 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
ccuccugcugcuugugguuuu

SEQ ID NO: 3354 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
ccuccugcugcuugugguuuu

SEQ ID NO: 3355 - DNA, 21 bp, Artificial Sequence
  Synthetic polynucleotide
  modified_base (1)..(21): Positions 1-2, 4-5, 7, 10-11, 18 2'-O-methyl ribonucleotide
  modified_base (21)..(21): phosphorothioate linked nucleoside
cuaucaugaccaaggaguatt

SEQ ID NO: 3356 - DNA, 21 bp, Artificial Sequence
  Synthetic polynucleotide
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
cuaucaugaccaaggaguauu

SEQ ID NO: 3357 - DNA, 21 bp, Artificial Sequence
  Synthetic polynucleotide
  modified_base (1)..(21): Positions 1, 3, 5, 7-8, 10-11, 13, 15, 17, 19, 21 2'-deoxy-2'-fluoro ("2'-fluoro") ribonucleotide
  modified_base (1)..(21): Positions 2, 4, 6, 9, 12, 14, 16, 18, 20 2'-O-methyl ribonucleotide
cuaucaugaccaaggaguauu

SEQ ID NO: 3358 - DNA, 21 bp, Artificial Sequence
  Synthetic polynucleotide
  modified_base (1)..(21): Positions 1, 3, 5, 7, 10-11, 13, 15, 17, 19, 21 2'-deoxy-2'-fluoro ("2'-fluoro") ribonucleotide
  modified_base (1)..(21): Positions 2, 4, 6, 8-9, 12, 14, 16, 18, 20 2'-O-methyl ribonucleotide
cuaucaugaccaaggaguauu

SEQ ID NO: 3359 - DNA, 21 bp, Artificial Sequence
  Synthetic polynucleotide
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
cuaucaugaccaaggaguauu

SEQ ID NO: 3360 - DNA, 21 bp, Artificial Sequence
  Synthetic polynucleotide
  modified_base (1)..(21): Positions 1, 3, 5, 7, 9-10, 12-13, 15, 17, 19, 21 2'-deoxy-2'-fluoro ("2'-fluoro") ribonucleotide
  modified_base (1)..(21): Positions 2, 4, 6, 8, 11, 14, 16, 18, 20 2'-O-methyl ribonucleotide
cuaucaugaccaaggaguauu

SEQ ID NO: 3361 - DNA, 21 bp, Artificial Sequence
  Synthetic polynucleotide
  modified_base (1)..(21): Positions 1, 3, 5, 7, 9-10, 13, 15, 17, 19, 21 2'-deoxy-2'-fluoro ("2'-fluoro") ribonucleotide
  modified_base (1)..(21): Positions 2, 4, 6, 8, 11-12, 14, 16, 18, 20 2'-O-methyl ribonucleotide
cuaucaugaccaaggaguauu

SEQ ID NO: 3362 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
cuaucaugaccaaggaguauu

SEQ ID NO: 3363 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
cuaucaugaccaaggaguauu

SEQ ID NO: 3364 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (2)..(3): phosphorothioate linked nucleoside
cuaucaugaccaaggaguauu

SEQ ID NO: 3365 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
cuaucaugaccaaggaguauu

SEQ ID NO: 3366 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
  modified_base (2)..(3): phosphorothioate linked nucleoside
cuaucaugaccaaggaguauu

SEQ ID NO: 3367 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
cuaucaugaccaaggaguauu

SEQ ID NO: 3368 - DNA, 21 bp, Artificial Sequence
  Synthetic polynucleotide
  modified_base (1)..(21): Positions 1, 3, 5-6, 9, 11, 13, 15, 17, 19, 21 2'-deoxy-2'-fluoro ("2'-fluoro") ribonucleotide
  modified_base (1)..(21): Positions 2, 4, 7-8, 10, 12, 14, 16, 18, 20 2'-O-methyl ribonucleotide
cuaucaugaccaaggaguauu

SEQ ID NO: 3369 - DNA, 21 bp, Artificial Sequence
  Synthetic polynucleotide
  modified_base (1)..(21): Positions 1, 3, 6-7, 9, 11, 13, 15, 17, 19, 21 2'-deoxy-2'-fluoro ("2'-fluoro") ribonucleotide
  modified_base (1)..(21): Positions 2, 4-5, 8, 10, 12, 14, 16, 18, 20 2'-O-methyl ribonucleotide
cuaucaugaccaaggaguauu

SEQ ID NO: 3370 - DNA, 21 bp, Artificial Sequence
  Synthetic polynucleotide
  modified_base (1)..(21): Positions 1, 3-4, 7, 9, 11, 13, 15, 17, 19, 21 2'-deoxy-2'-fluoro ("2'-fluoro") ribonucleotide
  modified_base (1)..(21): Positions 2, 5-6, 8, 10, 12, 14, 16, 18, 20 2'-O-methyl ribonucleotide
cuaucaugaccaaggaguauu

SEQ ID NO: 3371 - DNA, 21 bp, Artificial Sequence
  Synthetic polynucleotide
  modified_base (1)..(21): Positions 1, 4-5, 7, 9, 11, 13, 15, 17, 19, 21 2'-deoxy-2'-fluoro ("2'-fluoro") ribonucleotide
  modified_base (1)..(21): Positions 2-3, 6, 8, 10, 12, 14, 16, 18, 20 2'-O-methyl ribonucleotide
cuaucaugaccaaggaguauu

SEQ ID NO: 3372 - DNA, 21 bp, Artificial Sequence
  Synthetic polynucleotide
  modified_base (1)..(21): Positions 1-2, 5, 7, 9, 11, 13, 15, 17, 19, 21 2'-deoxy-2'-fluoro ("2'-fluoro") ribonucleotide
  modified_base (1)..(21): Positions 3-4, 6, 8, 10, 12, 14, 16, 18, 20 2'-O-methyl ribonucleotide
cuaucaugaccaaggaguauu

SEQ ID NO: 3373 - DNA, 21 bp, Artificial Sequence
  Synthetic polynucleotide
  modified_base (1)..(21): Positions 2-3, 5, 7, 9, 11, 13, 15, 17, 19, 21 2'-deoxy-2'-fluoro ("2'-fluoro") ribonucleotide
  modified_base (1)..(21): Positions 1, 4, 6, 8, 10, 12, 14, 16, 18, 20 2'-O-methyl ribonucleotide
cuaucaugaccaaggaguauu

SEQ ID NO: 3374 - DNA, 21 bp, Artificial Sequence
  Synthetic polynucleotide
  modified_base (1)..(21): Positions 3, 5, 7, 9, 11, 13, 15, 17, 19, 21 2'-deoxy-2'-fluoro ("2'-fluoro") ribonucleotide
  modified_base (1)..(21): Positions 1-2, 4, 6, 8, 10, 12, 14, 16, 18, 20 2'-O-methyl ribonucleotide
cuaucaugaccaaggaguauu

SEQ ID NO: 3375 - DNA, 21 bp, Artificial Sequence
  Synthetic polynucleotide
  modified_base (1)..(21): Positions 1, 3, 5, 7, 9, 11, 14-15, 17, 19, 21 2'-deoxy-2'-fluoro ("2'-fluoro") ribonucleotide
  modified_base (1)..(21): Positions 2, 4, 6, 8, 10, 12-13, 16, 18, 20 2'-O-methyl ribonucleotide
cuaucaugaccaaggaguauu

SEQ ID NO: 3376 - DNA, 21 bp, Artificial Sequence
  Synthetic polynucleotide
  modified_base (1)..(21): Positions 1, 3, 5, 7, 9, 11, 13-14, 17, 19, 21 2'-deoxy-2'-fluoro ("2'-fluoro") ribonucleotide
  modified_base (1)..(21): Positions 2, 4, 6, 8, 10, 12, 15-16, 18, 20 2'-O-methyl ribonucleotide
cuaucaugaccaaggaguauu

SEQ ID NO: 3377 - DNA, 21 bp, Artificial Sequence
  Synthetic polynucleotide
  modified_base (1)..(21): Positions 1, 3, 5, 7, 9, 11, 13, 15-16, 19, 21 2'-deoxy-2'-fluoro ("2'-fluoro") ribonucleotide
  modified_base (1)..(21): Positions 2, 4, 6, 8, 10, 12, 14-15, 18, 20 2'-O-methyl ribonucleotide
cuaucaugaccaaggaguauu

SEQ ID NO: 3378 - DNA, 21 bp, Artificial Sequence
  Synthetic polynucleotide
  modified_base (1)..(21): Positions 1, 3, 5, 7, 9, 11, 13, 15-16, 19, 21 2'-deoxy-2'-fluoro ("2'-fluoro") ribonucleotide
  modified_base (1)..(21): Positions 2, 4, 6, 8, 10, 12, 14, 17-18, 20 2'-O-methyl ribonucleotide
cuaucaugaccaaggaguauu

SEQ ID NO: 3379 - DNA, 21 bp, Artificial Sequence
  Synthetic polynucleotide
  modified_base (1)..(21): Positions 1, 3, 5, 7, 9, 11, 13, 15, 18-19, 21 2'-deoxy-2'-fluoro ("2'-fluoro") ribonucleotide
  modified_base (1)..(21): Positions 2, 4, 6, 8, 10, 12, 14, 16-17, 20 2'-O-methyl ribonucleotide
cuaucaugaccaaggaguauu

SEQ ID NO: 3380 - DNA, 21 bp, Artificial Sequence
  Synthetic polynucleotide
  modified_base (1)..(21): Positions 1, 3, 5, 7, 9, 11, 13, 15, 17-18, 21 2'-deoxy-2'-fluoro ("2'-fluoro") ribonucleotide
  modified_base (1)..(21): Positions 2, 4, 6, 8, 10, 12, 14, 16, 19-20 2'-O-methyl ribonucleotide
cuaucaugaccaaggaguauu

SEQ ID NO: 3381 - DNA, 21 bp, Artificial Sequence
  Synthetic polynucleotide
  modified_base (1)..(21): Positions 1, 3, 5, 7, 9, 11, 13, 15, 17, 20-21 2'-deoxy-2'-fluoro ("2'-fluoro") ribonucleotide
  modified_base (1)..(21): Positions 2, 4, 6, 8, 10, 12, 14, 16, 18-19 2'-O-methyl ribonucleotide
cuaucaugaccaaggaguauu

SEQ ID NO: 3382 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4,7-8, 11-12, 15-16, 19-20 2'-O-methyl ribonucleotide
cuaucaugaccaaggaguauu

SEQ ID NO: 3383 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
cuaucaugaccaaggaguauu

SEQ ID NO: 3384 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
cuaucaugaccaaggaguauu

SEQ ID NO: 3385 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
cuaucaugaccaaggaguauu

SEQ ID NO: 3386 - DNA, 21 bp, Artificial Sequence
  Synthetic polynucleotide
  modified_base (1)..(21): Positions 1, 3-6, 15 2'-O-methyl ribonucleotide
  modified_base (21)..(21): phosphorothioate linked nucleoside
cguccugggaggagcagaatt

SEQ ID NO: 3387 - DNA, 21 bp, Artificial Sequence
  Synthetic polynucleotide
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
cguccugggaggagcagaauu

SEQ ID NO: 3388 - DNA, 21 bp, Artificial Sequence
  Synthetic polynucleotide
  modified_base (1)..(21): Positions 1, 3, 5, 7-8, 10-11, 13, 15, 17, 19, 21 2'-deoxy-2'-fluoro ("2'-fluoro") ribonucleotide
  modified_base (1)..(21): Positions 2, 4, 6, 9, 12, 14, 16, 18, 20 2'-O-methyl ribonucleotide
cguccugggaggagcagaauu

SEQ ID NO: 3389 - DNA, 21 bp, Artificial Sequence
  Synthetic polynucleotide
  modified_base (1)..(21): Positions 1, 3, 5, 7, 10-11, 13, 15, 17, 19, 21 2'-deoxy-2'-fluoro ("2'-fluoro") ribonucleotide
  modified_base (1)..(21): Positions 2, 4, 6, 8-9, 12, 14, 16, 18, 20 2'-O-methyl ribonucleotide
cguccugggaggagcagaauu

SEQ ID NO: 3390 - DNA, 21 bp, Artificial Sequence
  Synthetic polynucleotide
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
cguccugggaggagcagaauu

SEQ ID NO: 3391 - DNA, 21 bp, Artificial Sequence
  Synthetic polynucleotide
  modified_base (1)..(21): Positions 1, 3, 5, 7, 9-10, 12-13, 15, 17, 19, 21 2'-deoxy-2'-fluoro ("2'-fluoro") ribonucleotide
  modified_base (1)..(21): Positions 2, 4, 6, 8, 11, 14, 16, 18, 20 2'-O-methyl ribonucleotide
cguccugggaggagcagaauu

SEQ ID NO: 3392 - DNA, 21 bp, Artificial Sequence
  Synthetic polynucleotide
  modified_base (1)..(21): Positions 1, 3, 5, 7, 9-10, 13, 15, 17, 19, 21 2'-deoxy-2'-fluoro ("2'-fluoro") ribonucleotide
  modified_base (1)..(21): Positions 2, 4, 6, 8, 11-12, 14, 16, 18, 20 2'-O-methyl ribonucleotide
cguccugggaggagcagaauu

SEQ ID NO: 3393 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
cguccugggaggagcagaauu

SEQ ID NO: 3394 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
cguccugggaggagcagaauu

SEQ ID NO: 3395 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (2)..(3): phosphorothioate linked nucleoside
cguccugggaggagcagaauu

SEQ ID NO: 3396 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
cguccugggaggagcagaauu

SEQ ID NO: 3397 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
  modified_base (2)..(3): phosphorothioate linked nucleoside
cguccugggaggagcagaauu

SEQ ID NO: 3398 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
cguccugggaggagcagaauu

SEQ ID NO: 3399 - DNA, 21 bp, Artificial Sequence
  Synthetic polynucleotide
  modified_base (1)..(21): Positions 1, 3, 5-6, 9, 11, 13, 15, 17, 19, 21 2'-deoxy-2'-fluoro ("2'-fluoro") ribonucleotide
  modified_base (1)..(21): Positions 2, 4, 7-8, 10, 12, 14, 16, 18, 20 2'-O-methyl ribonucleotide
cguccugggaggagcagaauu

SEQ ID NO: 3400 - DNA, 21 bp, Artificial Sequence
  Synthetic polynucleotide
  modified_base (1)..(21): Positions 1, 3, 6-7, 9, 11, 13, 15, 17, 19, 21 2'-deoxy-2'-fluoro ("2'-fluoro") ribonucleotide
  modified_base (1)..(21): Positions 2, 4-5, 8, 10, 12, 14, 16, 18, 20 2'-O-methyl ribonucleotide
cguccugggaggagcagaauu

SEQ ID NO: 3401 - DNA, 21 bp, Artificial Sequence
  Synthetic polynucleotide
  modified_base (1)..(21): Positions 1, 3-4, 7, 9, 11, 13, 15, 17, 19, 21 2'-deoxy-2'-fluoro ("2'-fluoro") ribonucleotide
  modified_base (1)..(21): Positions 2, 5-6, 8, 10, 12, 14, 16, 18, 20 2'-O-methyl ribonucleotide
cguccugggaggagcagaauu

SEQ ID NO: 3402 - DNA, 21 bp, Artificial Sequence
  Synthetic polynucleotide
  modified_base (1)..(21): Positions 1, 4-5, 7, 9, 11, 13, 15, 17, 19, 21 2'-deoxy-2'-fluoro ("2'-fluoro") ribonucleotide
  modified_base (1)..(21): Positions 2-3, 6, 8, 10, 12, 14, 16, 18, 20 2'-O-methyl ribonucleotide
cguccugggaggagcagaauu

SEQ ID NO: 3403 - DNA, 21 bp, Artificial Sequence
  Synthetic polynucleotide
  modified_base (1)..(21): Positions 1-2, 5, 7, 9, 11, 13, 15, 17, 19, 21 2'-deoxy-2'-fluoro ("2'-fluoro") ribonucleotide
  modified_base (1)..(21): Positions 3-4, 6, 8, 10, 12, 14, 16, 18, 20 2'-O-methyl ribonucleotide
cguccugggaggagcagaauu

SEQ ID NO: 3404 - DNA, 21 bp, Artificial Sequence
  Synthetic polynucleotide
  modified_base (1)..(21): Positions 2-3, 5, 7, 9, 11, 13, 15, 17, 19, 21 2'-deoxy-2'-fluoro ("2'-fluoro") ribonucleotide
  modified_base (1)..(21): Positions 1, 4, 6, 8, 10, 12, 14, 16, 18, 20 2'-O-methyl ribonucleotide
cguccugggaggagcagaauu

SEQ ID NO: 3405 - DNA, 21 bp, Artificial Sequence
  Synthetic polynucleotide
  modified_base (1)..(21): Positions 3, 5, 7, 9, 11, 13, 15, 17, 19, 21 2'-deoxy-2'-fluoro ("2'-fluoro") ribonucleotide
  modified_base (1)..(21): Positions 1-2, 4, 6, 8, 10, 12, 14, 16, 18, 20 2'-O-methyl ribonucleotide
cguccugggaggagcagaauu

SEQ ID NO: 3406 - DNA, 21 bp, Artificial Sequence
  Synthetic polynucleotide
  modified_base (1)..(21): Positions 1, 3, 5, 7, 9, 11, 14-15, 17, 19, 21 2'-deoxy-2'-fluoro ("2'-fluoro") ribonucleotide
  modified_base (1)..(21): Positions 2, 4, 6, 8, 10, 12-13, 16, 18, 20 2'-O-methyl ribonucleotide
cguccugggaggagcagaauu

SEQ ID NO: 3407 - DNA, 21 bp, Artificial Sequence
  Synthetic polynucleotide
  modified_base (1)..(21): Positions 1, 3, 5, 7, 9, 11, 13-14, 17, 19, 21 2'-deoxy-2'-fluoro ("2'-fluoro") ribonucleotide
  modified_base (1)..(21): Positions 2, 4, 6, 8, 10, 12, 15-16, 18, 20 2'-O-methyl ribonucleotide
cguccugggaggagcagaauu

SEQ ID NO: 3408 - DNA, 21 bp, Artificial Sequence
  Synthetic polynucleotide
  modified_base (1)..(21): Positions 1, 3, 5, 7, 9, 11, 13, 16-17, 19, 21 2'-deoxy-2'-fluoro ("2'-fluoro") ribonucleotide
  modified_base (1)..(21): Positions 2, 4, 6, 8, 10, 12, 14-15, 18, 20 2'-O-methyl ribonucleotide
cguccugggaggagcagaauu

SEQ ID NO: 3409 - DNA, 21 bp, Artificial Sequence
  Synthetic polynucleotide
  modified_base (1)..(21): Positions 1, 3, 5, 7, 9, 11, 13, 15-16, 19, 21 2'-deoxy-2'-fluoro ("2'-fluoro") ribonucleotide
  modified_base (1)..(21): Positions 2, 4, 6, 8, 10, 12, 14, 17-18, 20 2'-O-methyl ribonucleotide
cguccugggaggagcagaauu

SEQ ID NO: 3410 - DNA, 21 bp, Artificial Sequence
  Synthetic polynucleotide
  modified_base (1)..(21): Positions 1, 3, 5, 7, 9, 11, 13, 15, 18-19, 21 2'-deoxy-2'-fluoro ("2'-fluoro") ribonucleotide
  modified_base (1)..(21): Positions 2, 4, 6, 8, 10, 12, 14, 16-17, 20 2'-O-methyl ribonucleotide
cguccugggaggagcagaauu

SEQ ID NO: 3411 - DNA, 21 bp, Artificial Sequence
  Synthetic polynucleotide
  modified_base (1)..(21): Positions 1, 3, 5, 7, 9, 11, 13, 15, 17-18, 21 2'-deoxy-2'-fluoro ("2'-fluoro") ribonucleotide
  modified_base (1)..(21): Positions 2, 4, 6, 8, 10, 12, 14, 16, 19-20 2'-O-methyl ribonucleotide
cguccugggaggagcagaauu

SEQ ID NO: 3412 - DNA, 21 bp, Artificial Sequence
  Synthetic polynucleotide
  modified_base (1)..(21): Positions 1, 3, 5, 7, 9, 11, 13, 15, 17, 20-21 2'-deoxy-2'-fluoro ("2'-fluoro") ribonucleotide
  modified_base (1)..(21): Positions 2, 4, 6, 8, 10, 12, 14, 16, 18-19 2'-O-methyl ribonucleotide
cguccugggaggagcagaauu

SEQ ID NO: 3413 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
cguccugggaggagcagaauu

SEQ ID NO: 3414 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
cguccugggaggagcagaauu

SEQ ID NO: 3415 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
cguccugggaggagcagaauu

SEQ ID NO: 3416 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
cguccugggaggagcagaauu

SEQ ID NO: 3417 - DNA, 21 bp, Artificial Sequence
  Synthetic polynucleotide
  modified_base (1)..(21): Positions 1-2, 8-15, 17-19 2'-O-methyl ribonucleotide
  modified_base (21)..(21): phosphorothioate linked nucleoside
cugggggccucuucugcuutt

SEQ ID NO: 3418 - DNA, 21 bp, Artificial Sequence
  Synthetic polynucleotide
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
cugggggccucuucugcuuuu

SEQ ID NO: 3419 - DNA, 21 bp, Artificial Sequence
  Synthetic polynucleotide
  modified_base (1)..(21): Positions 1, 3, 5, 7-8, 10-11, 13, 15, 17, 19, 21 2'-deoxy-2'-fluoro ("2'-fluoro") ribonucleotide
  modified_base (1)..(21): Positions 2, 4, 6, 9, 12, 14, 16, 18, 20 2'-O-methyl ribonucleotide
cugggggccucuucugcuuuu

SEQ ID NO: 3420 - DNA, 21 bp, Artificial Sequence
  Synthetic polynucleotide
  modified_base (1)..(21): Positions 1, 3, 5, 7, 10-11, 13, 15, 17, 19, 21 2'-deoxy-2'-fluoro ("2'-fluoro") ribonucleotide
  modified_base (1)..(21): Positions 2, 4, 6, 8-9, 12, 14, 16, 18, 20 2'-O-methyl ribonucleotide
cugggggccucuucugcuuuu

SEQ ID NO: 3421 - DNA, 21 bp, Artificial Sequence
  Synthetic polynucleotide
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
cugggggccucuucugcuuuu

SEQ ID NO: 3422 - DNA, 21 bp, Artificial Sequence
  Synthetic polynucleotide
  modified_base (1)..(21): Positions 1, 3, 5, 7, 9-10, 12-13, 15, 17, 19, 21 2'-deoxy-2'-fluoro ("2'-fluoro") ribonucleotide
  modified_base (1)..(21): Positions 2, 4, 6, 8, 11, 14, 16, 18, 20 2'-O-methyl ribonucleotide
cugggggccucuucugcuuuu

SEQ ID NO: 3423 - DNA, 21 bp, Artificial Sequence
  Synthetic polynucleotide
  modified_base (1)..(21): Positions 1, 3, 5, 7, 9-10, 13, 15, 17, 19, 21 2'-deoxy-2'-fluoro ("2'-fluoro") ribonucleotide
  modified_base (1)..(21): Positions 2, 4, 6, 8, 11-12, 14, 16, 18, 20 2'-O-methyl ribonucleotide
cugggggccucuucugcuuuu

SEQ ID NO: 3424 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
cugggggccucuucugcuuuu

SEQ ID NO: 3425 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
cugggggccucuucugcuuuu

SEQ ID NO: 3426 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (2)..(3): phosphorothioate linked nucleoside
cugggggccucuucugcuuuu

SEQ ID NO: 3427 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
cugggggccucuucugcuuuu

SEQ ID NO: 3428 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
  modified_base (2)..(3): phosphorothioate linked nucleoside
cugggggccucuucugcuuuu

SEQ ID NO: 3429 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
cugggggccucuucugcuuuu

SEQ ID NO: 3430 - DNA, 21 bp, Artificial Sequence
  Synthetic polynucleotide
  modified_base (1)..(21): Positions 1, 3, 5-6, 9, 11, 13, 15, 17, 19, 21 2'-deoxy-2'-fluoro ("2'-fluoro") ribonucleotide
  modified_base (1)..(21): Positions 2, 4, 7-8, 10, 12, 14, 16, 18, 20 2'-O-methyl ribonucleotide
cugggggccucuucugcuuuu

SEQ ID NO: 3431 - DNA, 21 bp, Artificial Sequence
  Synthetic polynucleotide
  modified_base (1)..(21): Positions 1, 3, 6-7, 9, 11, 13, 15, 17, 19, 21 2'-deoxy-2'-fluoro ("2'-fluoro") ribonucleotide
  modified_base (1)..(21): Positions 2, 4-5, 8, 10, 12, 14, 16, 18, 20 2'-O-methyl ribonucleotide
cugggggccucuucugcuuuu

SEQ ID NO: 3432 - DNA, 21 bp, Artificial Sequence
  Synthetic polynucleotide
  modified_base (1)..(21): Positions 1, 3-4, 7, 9, 11, 13, 15, 17, 19, 21 2'-deoxy-2'-fluoro ("2'-fluoro") ribonucleotide
  modified_base (1)..(21): Positions 2, 5-6, 8, 10, 12, 14, 16, 18, 20 2'-O-methyl ribonucleotide
cugggggccucuucugcuuuu

SEQ ID NO: 3433 - DNA, 21 bp, Artificial Sequence
  Synthetic polynucleotide
  modified_base (1)..(21): Positions 1, 4-5, 7, 9, 11, 13, 15, 17, 19, 21 2'-deoxy-2'-fluoro ("2'-fluoro") ribonucleotide
  modified_base (1)..(21): Positions 2-3, 6, 8, 10, 12, 14, 16, 18, 20 2'-O-methyl ribonucleotide
cugggggccucuucugcuuuu

SEQ ID NO: 3434 - DNA, 21 bp, Artificial Sequence
  Synthetic polynucleotide
  modified_base (1)..(21): Positions 1-2, 5, 7, 9, 11, 13, 15, 17, 19, 21 2'-deoxy-2'-fluoro ("2'-fluoro") ribonucleotide
  modified_base (1)..(21): Positions 3-4, 6, 8, 10, 12, 14, 16, 18, 20 2'-O-methyl ribonucleotide
cugggggccucuucugcuuuu

SEQ ID NO: 3435 - DNA, 21 bp, Artificial Sequence
  Synthetic polynucleotide
  modified_base (1)..(21): Positions 2-3, 5, 7, 9, 11, 13, 15, 17, 19, 21 2'-deoxy-2'-fluoro ("2'-fluoro") ribonucleotide
  modified_base (1)..(21): Positions 1, 4, 6, 8, 10, 12, 14, 16, 18, 20 2'-O-methyl ribonucleotide
cugggggccucuucugcuuuu

SEQ ID NO: 3436 - DNA, 21 bp, Artificial Sequence
  Synthetic polynucleotide
  modified_base (1)..(21): Positions 3, 5, 7, 9, 11, 13, 15, 17, 19, 21 2'-deoxy-2'-fluoro ("2'-fluoro") ribonucleotide
  modified_base (1)..(21): Positions 1-2, 4, 6, 8, 10, 12, 14, 16, 18, 20 2'-O-methyl ribonucleotide
cugggggccucuucugcuuuu

SEQ ID NO: 3437 - DNA, 21 bp, Artificial Sequence
  Synthetic polynucleotide
  modified_base (1)..(21): Positions 1, 3, 5, 7, 9, 11, 14-15, 17, 19, 21 2'-deoxy-2'-fluoro ("2'-fluoro") ribonucleotide
  modified_base (1)..(21): Positions 2, 4, 6, 8, 10, 12-13, 16, 18, 20 2'-O-methyl ribonucleotide
cugggggccucuucugcuuuu

SEQ ID NO: 3438 - DNA, 21 bp, Artificial Sequence
  Synthetic polynucleotide
  modified_base (1)..(21): Positions 1, 3, 5, 7, 9, 11, 13-14, 17, 19, 21 2'-deoxy-2'-fluoro ("2'-fluoro") ribonucleotide
  modified_base (1)..(21): Positions 2, 4, 6, 8, 10, 12, 15-16, 18, 20 2'-O-methyl ribonucleotide
cugggggccucuucugcuuuu

SEQ ID NO: 3439 - DNA, 21 bp, Artificial Sequence
  Synthetic polynucleotide
  modified_base (1)..(21): Positions 1, 3, 5, 7, 9, 11, 13, 16-17, 19, 21 2'-deoxy-2'-fluoro ("2'-fluoro") ribonucleotide
  modified_base (1)..(21): Positions 2, 4, 6, 8, 10, 12, 14-15, 18, 20 2'-O-methyl ribonucleotide
cugggggccucuucugcuuuu

SEQ ID NO: 3440 - DNA, 21 bp, Artificial Sequence
  Synthetic polynucleotide
  modified_base (1)..(21): Positions 1, 3, 5, 7, 9, 11, 13, 15-16, 19, 21 2'-deoxy-2'-fluoro ("2'-fluoro") ribonucleotide
  modified_base (1)..(21): Positions 2, 4, 6, 8, 10, 12, 14, 17-18, 20 2'-O-methyl ribonucleotide
cugggggccucuucugcuuuu

SEQ ID NO: 3441 - DNA, 21 bp, Artificial Sequence
  Synthetic polynucleotide
  modified_base (1)..(21): Positions 1, 3, 5, 7, 9, 11, 13, 15, 18-19, 21 2'-deoxy-2'-fluoro ("2'-fluoro") ribonucleotide
  modified_base (1)..(21): Positions 2, 4, 6, 8, 10, 12, 14, 16-17, 20 2'-O-methyl ribonucleotide
cugggggccucuucugcuuuu

SEQ ID NO: 3442 - DNA, 21 bp, Artificial Sequence
  Synthetic polynucleotide
  modified_base (1)..(21): Positions 1, 3, 5, 7, 9, 11, 13, 15, 17-18, 21 2'-deoxy-2'-fluoro ("2'-fluoro") ribonucleotide
  modified_base (1)..(21): Positions 2, 4, 6, 8, 10, 12, 14, 16, 19-20 2'-O-methyl ribonucleotide
cugggggccucuucugcuuuu

SEQ ID NO: 3443 - DNA, 21 bp, Artificial Sequence
  Synthetic polynucleotide
  modified_base (1)..(21): Positions 1, 3, 5, 7, 9, 11, 13, 15, 17, 20-21 2'-deoxy-2'-fluoro ("2'-fluoro") ribonucleotide
  modified_base (1)..(21): Positions 2, 4, 6, 8, 10, 12, 14, 16, 18-19 2'-O-methyl ribonucleotide
cugggggccucuucugcuuuu

SEQ ID NO: 3444 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
cugggggccucuucugcuuuu

SEQ ID NO: 3445 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
cugggggccucuucugcuuuu

SEQ ID NO: 3446 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
cugggggccucuucugcuuuu

SEQ ID NO: 3447 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
cugggggccucuucugcuuuu

SEQ ID NO: 3448 - DNA, 21 bp, Artificial Sequence
  Synthetic polynucleotide
  modified_base (1)..(21): Positions 1-3, 5-6, 8, 11-12, 19 2'-O-methyl ribonucleotide
  modified_base (21)..(21): phosphorothioate linked nucleoside
ccuaucaugaccaaggagutt

SEQ ID NO: 3449 - DNA, 21 bp, Artificial Sequence
  Synthetic polynucleotide
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
ccuaucaugaccaaggaguuu

SEQ ID NO: 3450 - DNA, 21 bp, Artificial Sequence
  Synthetic polynucleotide
  modified_base (1)..(21): Positions 1, 3, 5, 7-8, 10-11, 13, 15, 17, 19, 21 2'-deoxy-2'-fluoro ("2'-fluoro") ribonucleotide
  modified_base (1)..(21): Positions 2, 4, 6, 9, 12, 14, 16, 18, 20 2'-O-methyl ribonucleotide
ccuaucaugaccaaggaguuu

SEQ ID NO: 3451 - DNA, 21 bp, Artificial Sequence
  Synthetic polynucleotide
  modified_base (1)..(21): Positions 1, 3, 5, 7, 10-11, 13, 15, 17, 19, 21 2'-deoxy-2'-fluoro ("2'-fluoro") ribonucleotide
  modified_base (1)..(21): Positions 2, 4, 6, 8-9, 12, 14, 16, 18, 20 2'-O-methyl ribonucleotide
ccuaucaugaccaaggaguuu

SEQ ID NO: 3452 - DNA, 21 bp, Artificial Sequence
  Synthetic polynucleotide
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
ccuaucaugaccaaggaguuu

SEQ ID NO: 3453 - DNA, 21 bp, Artificial Sequence
  Synthetic polynucleotide
  modified_base (1)..(21): Positions 1, 3, 5, 7, 9-10, 12-13, 15, 17, 19, 21 2'-deoxy-2'-fluoro ("2'-fluoro") ribonucleotide
  modified_base (1)..(21): Positions 2, 4, 6, 8, 11, 14, 16, 18, 20 2'-O-methyl ribonucleotide
ccuaucaugaccaaggaguuu

SEQ ID NO: 3454 - DNA, 21 bp, Artificial Sequence
  Synthetic polynucleotide
  modified_base (1)..(21): Positions 1, 3, 5, 7, 9-10, 13, 15, 17, 19, 21 2'-deoxy-2'-fluoro ("2'-fluoro") ribonucleotide
  modified_base (1)..(21): Positions 2, 4, 6, 8, 11-12, 14, 16, 18, 20 2'-O-methyl ribonucleotide
ccuaucaugaccaaggaguuu

SEQ ID NO: 3455 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
ccuaucaugaccaaggaguuu

SEQ ID NO: 3456 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
ccuaucaugaccaaggaguuu

SEQ ID NO: 3457 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (2)..(3): phosphorothioate linked nucleoside
ccuaucaugaccaaggaguuu

SEQ ID NO: 3458 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
ccuaucaugaccaaggaguuu

SEQ ID NO: 3459 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
  modified_base (2)..(3): phosphorothioate linked nucleoside
ccuaucaugaccaaggaguuu

SEQ ID NO: 3460 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
ccuaucaugaccaaggaguuu

SEQ ID NO: 3461 - DNA, 21 bp, Artificial Sequence
  Synthetic polynucleotide
  modified_base (1)..(21): Positions 1, 3, 5-6, 9, 11, 13, 15, 17, 19, 21 2'-deoxy-2'-fluoro ("2'-fluoro") ribonucleotide
  modified_base (1)..(21): Positions 2, 4, 7-8, 10, 12, 14, 16, 18, 20 2'-O-methyl ribonucleotide
ccuaucaugaccaaggaguuu

SEQ ID NO: 3462 - DNA, 21 bp, Artificial Sequence
  Synthetic polynucleotide
  modified_base (1)..(21): Positions 1, 3, 6-7, 9, 11, 13, 15, 17, 19, 21 2'-deoxy-2'-fluoro ("2'-fluoro") ribonucleotide
  modified_base (1)..(21): Positions 2, 4-5, 8, 10, 12, 14, 16, 18, 20 2'-O-methyl ribonucleotide
ccuaucaugaccaaggaguuu

SEQ ID NO: 3463 - DNA, 21 bp, Artificial Sequence
  Synthetic polynucleotide
  modified_base (1)..(21): Positions 1, 3-4, 7, 9, 11, 13, 15, 17, 19, 21 2'-deoxy-2'-fluoro ("2'-fluoro") ribonucleotide
  modified_base (1)..(21): Positions 2, 5-6, 8, 10, 12, 14, 16, 18, 20 2'-O-methyl ribonucleotide
ccuaucaugaccaaggaguuu

SEQ ID NO: 3464 - DNA, 21 bp, Artificial Sequence
  Synthetic polynucleotide
  modified_base (1)..(21): Positions 1, 4-5, 7, 9, 11, 13, 15, 17, 19, 21 2'-deoxy-2'-fluoro ("2'-fluoro") ribonucleotide
  modified_base (1)..(21): Positions 2-3, 6, 8, 10, 12, 14, 16, 18, 20 2'-O-methyl ribonucleotide
ccuaucaugaccaaggaguuu

SEQ ID NO: 3465 - DNA, 21 bp, Artificial Sequence
  Synthetic polynucleotide
  modified_base (1)..(21): Positions 1-2, 5, 7, 9, 11, 13, 15, 17, 19, 21 2'-deoxy-2'-fluoro ("2'-fluoro") ribonucleotide
  modified_base (1)..(21): Positions 3-4, 6, 8, 10, 12, 14, 16, 18, 20 2'-O-methyl ribonucleotide
ccuaucaugaccaaggaguuu

SEQ ID NO: 3466 - DNA, 21 bp, Artificial Sequence
  Synthetic polynucleotide
  modified_base (1)..(21): Positions 2-3, 5, 7, 9, 11, 13, 15, 17, 19, 21 2'-deoxy-2'-fluoro ("2'-fluoro") ribonucleotide
  modified_base (1)..(21): Positions 1, 4, 6, 8, 10, 12, 14, 16, 18, 20 2'-O-methyl ribonucleotide
ccuaucaugaccaaggaguuu

SEQ ID NO: 3467 - DNA, 21 bp, Artificial Sequence
  Synthetic polynucleotide
  modified_base (1)..(21): Positions 3, 5, 7, 9, 11, 13, 15, 17, 19, 21 2'-deoxy-2'-fluoro ("2'-fluoro") ribonucleotide
  modified_base (1)..(21): Positions 1-2, 4, 6, 8, 10, 12, 14, 16, 18, 20 2'-O-methyl ribonucleotide
ccuaucaugaccaaggaguuu

SEQ ID NO: 3468 - DNA, 21 bp, Artificial Sequence
  Synthetic polynucleotide
  modified_base (1)..(21): Positions 1, 3, 5, 7, 9, 11, 14-15, 17, 19, 21 2'-deoxy-2'-fluoro ("2'-fluoro") ribonucleotide
  modified_base (1)..(21): Positions 2, 4, 6, 8, 10, 12-13, 16, 18, 20 2'-O-methyl ribonucleotide
ccuaucaugaccaaggaguuu

SEQ ID NO: 3469 - DNA, 21 bp, Artificial Sequence
  Synthetic polynucleotide
  modified_base (1)..(21): Positions 1, 3, 5, 7, 9, 11, 13-14, 17, 19, 21 2'-deoxy-2'-fluoro ("2'-fluoro") ribonucleotide
  modified_base (1)..(21): Positions 2, 4, 6, 8, 10, 12, 15-16, 18, 20 2'-O-methyl ribonucleotide
ccuaucaugaccaaggaguuu

SEQ ID NO: 3470 - DNA, 21 bp, Artificial Sequence
  Synthetic polynucleotide
  modified_base (1)..(21): Positions 1, 3, 5, 7, 9, 11, 13, 16-17, 19, 21 2'-deoxy-2'-fluoro ("2'-fluoro") ribonucleotide
  modified_base (1)..(21): Positions 2, 4, 6, 8, 10, 12, 14-15, 18, 20 2'-O-methyl ribonucleotide
ccuaucaugaccaaggaguuu

SEQ ID NO: 3471 - DNA, 21 bp, Artificial Sequence
  Synthetic polynucleotide
  modified_base (1)..(21): Positions 1, 3, 5, 7, 9, 11, 13, 15-16, 19, 21 2'-deoxy-2'-fluoro ("2'-fluoro") ribonucleotide
  modified_base (1)..(21): Positions 2, 4, 6, 8, 10, 12, 14, 17-18, 20 2'-O-methyl ribonucleotide
ccuaucaugaccaaggaguuu

SEQ ID NO: 3472 - DNA, 21 bp, Artificial Sequence
  Synthetic polynucleotide
  modified_base (1)..(21): Positions 1, 3, 5, 7, 9, 11, 13, 15, 18-19, 21 2'-deoxy-2'-fluoro ("2'-fluoro") ribonucleotide
  modified_base (1)..(21): Positions 2, 4, 6, 8, 10, 12, 14, 16-17, 20 2'-O-methyl ribonucleotide
ccuaucaugaccaaggaguuu

SEQ ID NO: 3473 - DNA, 21 bp, Artificial Sequence
  Synthetic polynucleotide
  modified_base (1)..(21): Positions 1, 3, 5, 7, 9, 11, 13, 15, 17-18, 21 2'-deoxy-2'-fluoro ("2'-fluoro") ribonucleotide
  modified_base (1)..(21): Positions 2, 4, 6, 8, 10, 12, 14, 16, 19-20 2'-O-methyl ribonucleotide
ccuaucaugaccaaggaguuu

SEQ ID NO: 3474 - DNA, 21 bp, Artificial Sequence
  Synthetic polynucleotide
  modified_base (1)..(21): Positions 1, 3, 5, 7, 9, 11, 13, 15, 17, 20-21 2'-deoxy-2'-fluoro ("2'-fluoro") ribonucleotide
  modified_base (1)..(21): Positions 2, 4, 6, 8, 10, 12, 14, 16, 18-19 2'-O-methyl ribonucleotide
ccuaucaugaccaaggaguuu

SEQ ID NO: 3475 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
ccuaucaugaccaaggaguuu

SEQ ID NO: 3476 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
ccuaucaugaccaaggaguuu

SEQ ID NO: 3477 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
ccuaucaugaccaaggaguuu

SEQ ID NO: 3478 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
ccuaucaugaccaaggaguuu

SEQ ID NO: 3479 - DNA, 21 bp, Artificial Sequence
  Synthetic polynucleotide
  modified_base (1)..(21): Positions 1, 3, 15, 2'-O-methyl ribonucleotide
  modified_base (21)..(21): phosphorothioate linked nucleoside
ugugggaagaaagaugaagtt

SEQ ID NO: 3480 - DNA, 21 bp, Artificial Sequence
  Synthetic polynucleotide
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 8, 12, 14, 16, 18, 20 2'-O-methyl ribonucleotide
ugugggaagaaagaugaaguu

SEQ ID NO: 3481 - DNA, 21 bp, Artificial Sequence
  Synthetic polynucleotide
  modified_base (1)..(21): Positions 1, 3, 5, 7-8, 10-11, 13, 15, 17, 19, 21 2'-deoxy-2'-fluoro ("2'-fluoro") ribonucleotide
  modified_base (1)..(21): Positions 2, 4, 6, 9, 12, 14, 16, 18, 20 2'-O-methyl ribonucleotide
ugugggaagaaagaugaaguu

SEQ ID NO: 3482 - DNA, 21 bp, Artificial Sequence
  Synthetic polynucleotide
  modified_base (1)..(21): Positions 1, 3, 5, 7, 10-11, 13, 15, 17, 19, 21 2'-deoxy-2'-fluoro ("2'-fluoro") ribonucleotide
  modified_base (1)..(21): Positions 2, 4, 6, 8-9, 12, 14, 16, 18, 20 2'-O-methyl ribonucleotide
ugugggaagaaagaugaaguu

SEQ ID NO: 3483 - DNA, 21 bp, Artificial Sequence
  Synthetic polynucleotide
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
ugugggaagaaagaugaaguu

SEQ ID NO: 3484 - DNA, 21 bp, Artificial Sequence
  Synthetic polynucleotide
  modified_base (1)..(21): Positions 1, 3, 5, 7, 9-10, 12-13, 15, 17, 19, 21 2'-deoxy-2'-fluoro ("2'-fluoro") ribonucleotide
  modified_base (1)..(21): Positions 2, 4, 6, 8, 11, 14, 16, 18, 20 2'-O-methyl ribonucleotide
ugugggaagaaagaugaaguu

SEQ ID NO: 3485 - DNA, 21 bp, Artificial Sequence
  Synthetic polynucleotide
  modified_base (1)..(21): Positions 1, 3, 5, 7, 9-10, 13, 15, 17, 19, 21 2'-deoxy-2'-fluoro ("2'-fluoro") ribonucleotide
  modified_base (1)..(21): Positions 2, 4, 6, 8, 11-12, 14, 16, 18, 20 2'-O-methyl ribonucleotide
ugugggaagaaagaugaaguu

SEQ ID NO: 3486 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
ugugggaagaaagaugaaguu

SEQ ID NO: 3487 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
ugugggaagaaagaugaaguu

SEQ ID NO: 3488 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (2)..(3): phosphorothioate linked nucleoside
ugugggaagaaagaugaaguu

SEQ ID NO: 3489 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
ugugggaagaaagaugaaguu

SEQ ID NO: 3490 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
  modified_base (2)..(3): phosphorothioate linked nucleoside
ugugggaagaaagaugaaguu

SEQ ID NO: 3491 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
ugugggaagaaagaugaaguu

SEQ ID NO: 3492 - DNA, 21 bp, Artificial Sequence
  Synthetic polynucleotide
  modified_base (1)..(21): Positions 1, 3, 5-6, 9, 11, 13, 15, 17, 19, 21 2'-deoxy-2'-fluoro ("2'-fluoro") ribonucleotide
  modified_base (1)..(21): Positions 2, 4, 7-8, 10, 12, 14, 16, 18, 20 2'-O-methyl ribonucleotide
ugugggaagaaagaugaaguu

SEQ ID NO: 3493 - DNA, 21 bp, Artificial Sequence
  Synthetic polynucleotide
  modified_base (1)..(21): Positions 1, 3, 6-7, 9, 11, 13, 15, 17, 19, 21 2'-deoxy-2'-fluoro ("2'-fluoro") ribonucleotide
  modified_base (1)..(21): Positions 2, 4-5, 8, 10, 12, 14, 16, 18, 20 2'-O-methyl ribonucleotide
ugugggaagaaagaugaaguu

SEQ ID NO: 3494 - DNA, 21 bp, Artificial Sequence
  Synthetic polynucleotide
  modified_base (1)..(21): Positions 1, 3-4, 7, 9, 11, 13, 15, 17, 19, 21 2'-deoxy-2'-fluoro ("2'-fluoro") ribonucleotide
  modified_base (1)..(21): Positions 2, 5-6, 8, 10, 12, 14, 16, 18, 20 2'-O-methyl ribonucleotide
ugugggaagaaagaugaaguu

SEQ ID NO: 3495 - DNA, 21 bp, Artificial Sequence
  Synthetic polynucleotide
  modified_base (1)..(21): Positions 1, 4-5, 7, 9, 11, 13, 15, 17, 19, 21 2'-deoxy-2'-fluoro ("2'-fluoro") ribonucleotide
  modified_base (1)..(21): Positions 2-3, 6, 8, 10, 12, 14, 16, 18, 20 2'-O-methyl ribonucleotide
ugugggaagaaagaugaaguu

SEQ ID NO: 3496 - DNA, 21 bp, Artificial Sequence
  Synthetic polynucleotide
  modified_base (1)..(21): Positions 1-2, 5, 7, 9, 11, 13, 15, 17, 19, 21 2'-deoxy-2'-fluoro ("2'-fluoro") ribonucleotide
  modified_base (1)..(21): Positions 3-4, 6, 8, 10, 12, 14, 16, 18, 20 2'-O-methyl ribonucleotide
ugugggaagaaagaugaaguu

SEQ ID NO: 3497 - DNA, 21 bp, Artificial Sequence
  Synthetic polynucleotide
  modified_base (1)..(21): Positions 2-3, 5, 7, 9, 11, 13, 15, 17, 19, 21 2'-deoxy-2'-fluoro ("2'-fluoro") ribonucleotide
  modified_base (1)..(21): Positions 1, 4, 6, 8, 10, 12, 14, 16, 18, 20 2'-O-methyl ribonucleotide
ugugggaagaaagaugaaguu

SEQ ID NO: 3498 - DNA, 21 bp, Artificial Sequence
  Synthetic polynucleotide
  modified_base (1)..(21): Positions 3, 5, 7, 9, 11, 13, 15, 17, 19, 21 2'-deoxy-2'-fluoro ("2'-fluoro") ribonucleotide
  modified_base (1)..(21): Positions 1-2, 4, 6, 8, 10, 12, 14, 16, 18, 20 2'-O-methyl ribonucleotide
ugugggaagaaagaugaaguu

SEQ ID NO: 3499 - DNA, 21 bp, Artificial Sequence
  Synthetic polynucleotide
  modified_base (1)..(21): Positions 1, 3, 5, 7, 9, 11, 14-15, 17, 19, 21 2'-deoxy-2'-fluoro ("2'-fluoro") ribonucleotide
  modified_base (1)..(21): Positions 2, 4, 6, 8, 10, 12-13, 16, 18, 20 2'-O-methyl ribonucleotide
ugugggaagaaagaugaaguu

SEQ ID NO: 3500 - DNA, 21 bp, Artificial Sequence
  Synthetic polynucleotide
  modified_base (1)..(21): Positions 1, 3, 5, 7, 9, 11, 13-14, 17, 19, 21 2'-deoxy-2'-fluoro ("2'-fluoro") ribonucleotide
  modified_base (1)..(21): Positions 2, 4, 6, 8, 10, 12, 15-16, 18, 20 2'-O-methyl ribonucleotide
ugugggaagaaagaugaaguu

SEQ ID NO: 3501 - DNA, 21 bp, Artificial Sequence
  Synthetic polynucleotide
  modified_base (1)..(21): Positions 1, 3, 5, 7, 9, 11, 13, 16-17, 19, 21 2'-deoxy-2'-fluoro ("2'-fluoro") ribonucleotide
  modified_base (1)..(21): Positions 2, 4, 6, 8, 10, 12, 14-15, 18, 20 2'-O-methyl ribonucleotide
ugugggaagaaagaugaaguu

SEQ ID NO: 3502 - DNA, 21 bp, Artificial Sequence
  Synthetic polynucleotide
  modified_base (1)..(21): Positions 1, 3, 5, 7, 9, 11, 13, 15-16, 19, 21 2'-deoxy-2'-fluoro ("2'-fluoro") ribonucleotide
  modified_base (1)..(21): Positions 2, 4, 6, 8, 10, 12, 14, 17-18, 20 2'-O-methyl ribonucleotide
ugugggaagaaagaugaaguu

SEQ ID NO: 3503 - DNA, 21 bp, Artificial Sequence
  Synthetic polynucleotide
  modified_base (1)..(21): Positions 1, 3, 5, 7, 9, 11, 13, 15, 18-19, 21 2'-deoxy-2'-fluoro ("2'-fluoro") ribonucleotide
  modified_base (1)..(21): Positions 2, 4, 6, 8, 10, 12, 14, 16-17, 20 2'-O-methyl ribonucleotide
ugugggaagaaagaugaaguu

SEQ ID NO: 3504 - DNA, 21 bp, Artificial Sequence
  Synthetic polynucleotide
  modified_base (1)..(21): Positions 1, 3, 5, 7, 9, 11, 13, 15, 17-18, 21 2'-deoxy-2'-fluoro ("2'-fluoro") ribonucleotide
  modified_base (1)..(21): Positions 2, 4, 6, 8, 10, 12, 14, 16, 19-20 2'-O-methyl ribonucleotide
ugugggaagaaagaugaaguu

SEQ ID NO: 3505 - DNA, 21 bp, Artificial Sequence
  Synthetic polynucleotide
  modified_base (1)..(21): Positions 1, 3, 5, 7, 9, 11, 13, 15, 17, 20-21 2'-deoxy-2'-fluoro ("2'-fluoro") ribonucleotide
  modified_base (1)..(21): Positions 2, 4, 6, 8, 10, 12, 14, 16, 18-19 2'-O-methyl ribonucleotide
ugugggaagaaagaugaaguu

SEQ ID NO: 3506 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
ugugggaagaaagaugaaguu

SEQ ID NO: 3507 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
ugugggaagaaagaugaaguu

SEQ ID NO: 3508 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
ugugggaagaaagaugaaguu

SEQ ID NO: 3509 - DNA, 21 bp, Artificial Sequence
  Synthetic polynucleotide
  modified_base (1)..(21): Positions 2-3, 6-7, 10-11, 14-15, 18-19, 20-21 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
ugugggaagaaagaugaaguu

SEQ ID NO: 3510 - DNA, 21 bp, Artificial Sequence
  Synthetic polynucleotide
  modified_base (1)..(21): Positions 5-6, 8, 10-12, 14-17, 19 2'-O-methyl ribonucleotide
  modified_base (21)..(21): phosphorothioate linked nucleoside
aggacugugcccacuucactt

SEQ ID NO: 3511 - DNA, 21 bp, Artificial Sequence
  Synthetic polynucleotide
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
aggacugugcccacuucacuu

SEQ ID NO: 3512 - DNA, 21 bp, Artificial Sequence
  Synthetic polynucleotide
  modified_base (1)..(21): Positions 1, 3, 5, 7-8, 10-11, 13, 15, 17, 19, 21 2'-deoxy-2'-fluoro ("2'-fluoro") ribonucleotide
  modified_base (1)..(21): Positions 2, 4, 6, 9, 12, 14, 16, 18, 20 2'-O-methyl ribonucleotide
aggacugugcccacuucacuu

SEQ ID NO: 3513 - DNA, 21 bp, Artificial Sequence
  Synthetic polynucleotide
  modified_base (1)..(21): Positions 1, 3, 5, 7, 10-11, 13, 15, 17, 19, 21 2'-deoxy-2'-fluoro ("2'-fluoro") ribonucleotide
  modified_base (1)..(21): Positions 2, 4, 6, 8-9, 12, 14, 16, 18, 20 2'-O-methyl ribonucleotide
aggacugugcccacuucacuu

SEQ ID NO: 3514 - DNA, 21 bp, Artificial Sequence
  Synthetic polynucleotide
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
aggacugugcccacuucacuu

SEQ ID NO: 3515 - DNA, 21 bp, Artificial Sequence
  Synthetic polynucleotide
  modified_base (1)..(21): Positions 1, 3, 5, 7, 9-10, 12-13, 15, 17, 19, 21 2'-deoxy-2'-fluoro ("2'-fluoro") ribonucleotide
  modified_base (1)..(21): Positions 2, 4, 6, 8, 11, 14, 16, 18, 20 2'-O-methyl ribonucleotide
aggacugugcccacuucacuu

SEQ ID NO: 3516 - DNA, 21 bp, Artificial Sequence
  Synthetic polynucleotide
  modified_base (1)..(21): Positions 1, 3, 5, 7, 9-10, 13, 15, 17, 19, 21 2'-deoxy-2'-fluoro ("2'-fluoro") ribonucleotide
  modified_base (1)..(21): Positions 2, 4, 6, 8, 11-12, 14, 16, 18, 20 2'-O-methyl ribonucleotide
aggacugugcccacuucacuu

SEQ ID NO: 3517 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
aggacugugcccacuucacuu

SEQ ID NO: 3518 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
aggacugugcccacuucacuu

SEQ ID NO: 3519 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (2)..(3): phosphorothioate linked nucleoside
aggacugugcccacuucacuu

SEQ ID NO: 3520 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
aggacugugcccacuucacuu

SEQ ID NO: 3521 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
  modified_base (2)..(3): phosphorothioate linked nucleoside
aggacugugcccacuucacuu

SEQ ID NO: 3522 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
aggacugugcccacuucacuu

SEQ ID NO: 3523 - DNA, 21 bp, Artificial Sequence
  Synthetic polynucleotide
  modified_base (1)..(21): Positions 1, 3, 5-6, 9, 11, 13, 15, 17, 19, 21 2'-deoxy-2'-fluoro ("2'-fluoro") ribonucleotide
  modified_base (1)..(21): Positions 2, 4, 7-8, 10, 12, 14, 16, 18, 20 2'-O-methyl ribonucleotide
aggacugugcccacuucacuu

SEQ ID NO: 3524 - DNA, 21 bp, Artificial Sequence
  Synthetic polynucleotide
  modified_base (1)..(21): Positions 1, 3, 6-7, 9, 11, 13, 15, 17, 19, 21 2'-deoxy-2'-fluoro ("2'-fluoro") ribonucleotide
  modified_base (1)..(21): Positions 2, 4-5, 8, 10, 12, 14, 16, 18, 20 2'-O-methyl ribonucleotide
aggacugugcccacuucacuu

SEQ ID NO: 3525 - DNA, 21 bp, Artificial Sequence
  Synthetic polynucleotide
  modified_base (1)..(21): Positions 1, 3-4, 7, 9, 11, 13, 15, 17, 19, 21 2'-deoxy-2'-fluoro ("2'-fluoro") ribonucleotide
  modified_base (1)..(21): Positions 2, 5-6, 8, 10, 12, 14, 16, 18, 20 2'-O-methyl ribonucleotide
aggacugugcccacuucacuu

SEQ ID NO: 3526 - DNA, 21 bp, Artificial Sequence
  Synthetic polynucleotide
  modified_base (1)..(21): Positions 1, 4-5, 7, 9, 11, 13, 15, 17, 19, 21 2'-deoxy-2'-fluoro ("2'-fluoro") ribonucleotide
  modified_base (1)..(21): Positions 2-3, 6, 8, 10, 12, 14, 16, 18, 20 2'-O-methyl ribonucleotide
aggacugugcccacuucacuu

SEQ ID NO: 3527 - DNA, 21 bp, Artificial Sequence
  Synthetic polynucleotide
  modified_base (1)..(21): Positions 1-2, 5, 7, 9, 11, 13, 15, 17, 19, 21 2'-deoxy-2'-fluoro ("2'-fluoro") ribonucleotide
  modified_base (1)..(21): Positions 3-4, 6, 8, 10, 12, 14, 16, 18, 20 2'-O-methyl ribonucleotide
aggacugugcccacuucacuu

SEQ ID NO: 3528 - DNA, 21 bp, Artificial Sequence
  Synthetic polynucleotide
  modified_base (1)..(21): Positions 2-3, 5, 7, 9, 11, 13, 15, 17, 19, 21 2'-deoxy-2'-fluoro ("2'-fluoro") ribonucleotide
  modified_base (1)..(21): Positions 1, 4, 6, 8, 10, 12, 14, 16, 18, 20 2'-O-methyl ribonucleotide
aggacugugcccacuucacuu

SEQ ID NO: 3529 - DNA, 21 bp, Artificial Sequence
  Synthetic polynucleotide
  modified_base (1)..(21): Positions 3, 5, 7, 9, 11, 13, 15, 17, 19, 21 2'-deoxy-2'-fluoro ("2'-fluoro") ribonucleotide
  modified_base (1)..(21): Positions 1-2, 4, 6, 8, 10, 12, 14, 16, 18, 20 2'-O-methyl ribonucleotide
aggacugugcccacuucacuu

SEQ ID NO: 3530 - DNA, 21 bp, Artificial Sequence
  Synthetic polynucleotide
  modified_base (1)..(21): Positions 1, 3, 5, 7, 9, 11, 14-15, 17, 19, 21 2'-deoxy-2'-fluoro ("2'-fluoro") ribonucleotide
  modified_base (1)..(21): Positions 2, 4, 6, 8, 10, 12-13, 16, 18, 20 2'-O-methyl ribonucleotide
aggacugugcccacuucacuu

SEQ ID NO: 3531 - DNA, 21 bp, Artificial Sequence
  Synthetic polynucleotide
  modified_base (1)..(21): Positions 1, 3, 5, 7, 9, 11, 13-14, 17, 19, 21 2'-deoxy-2'-fluoro ("2'-fluoro") ribonucleotide
  modified_base (1)..(21): Positions 2, 4, 6, 8, 10, 12, 15-16, 18, 20 2'-O-methyl ribonucleotide
aggacugugcccacuucacuu

SEQ ID NO: 3532 - DNA, 21 bp, Artificial Sequence
  Synthetic polynucleotide
  modified_base (1)..(21): Positions 1, 3, 5, 7, 9, 11, 13, 16-17, 19, 21 2'-deoxy-2'-fluoro ("2'-fluoro") ribonucleotide
  modified_base (1)..(21): Positions 2, 4, 6, 8, 10, 12, 14-15, 18, 20 2'-O-methyl ribonucleotide
aggacugugcccacuucacuu

SEQ ID NO: 3533 - DNA, 21 bp, Artificial Sequence
  Synthetic polynucleotide
  modified_base (1)..(21): Positions 1, 3, 5, 7, 9, 11, 13, 15-16, 19, 21 2'-deoxy-2'-fluoro ("2'-fluoro") ribonucleotide
  modified_base (1)..(21): Positions 2, 4, 6, 8, 10, 12, 14, 17-18, 20 2'-O-methyl ribonucleotide
aggacugugcccacuucacuu

SEQ ID NO: 3534 - DNA, 21 bp, Artificial Sequence
  Synthetic polynucleotide
  modified_base (1)..(21): Positions 1, 3, 5, 7, 9, 11, 13, 15, 18-19, 21 2'-deoxy-2'-fluoro ("2'-fluoro") ribonucleotide
  modified_base (1)..(21): Positions 2, 4, 6, 8, 10, 12, 14, 16-17, 20 2'-O-methyl ribonucleotide
aggacugugcccacuucacuu

SEQ ID NO: 3535 - DNA, 21 bp, Artificial Sequence
  Synthetic polynucleotide
  modified_base (1)..(21): Positions 1, 3, 5, 7, 9, 11, 13, 15, 17-18, 21 2'-deoxy-2'-fluoro ("2'-fluoro") ribonucleotide
  modified_base (1)..(21): Positions 2, 4, 6, 8, 10, 12, 14, 16, 19-20 2'-O-methyl ribonucleotide
aggacugugcccacuucacuu

SEQ ID NO: 3536 - DNA, 21 bp, Artificial Sequence
  Synthetic polynucleotide
  modified_base (1)..(21): Positions 1, 3, 5, 7, 9, 11, 13, 15, 17, 20-21 2'-deoxy-2'-fluoro ("2'-fluoro") ribonucleotide
  modified_base (1)..(21): Positions 2, 4, 6, 8, 10, 12, 14, 16, 18-19 2'-O-methyl ribonucleotide
aggacugugcccacuucacuu

SEQ ID NO: 3537 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
aggacugugcccacuucacuu

SEQ ID NO: 3538 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
aggacugugcccacuucacuu

SEQ ID NO: 3539 - DNA, 21 bp, Artificial Sequence
  Synthetic polynucleotide
  modified_base (1)..(21): Positions 1, 4-5, 8-9, 12-13,  16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
aggacugugcccacuucacuu

SEQ ID NO: 3540 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
aggacugugcccacuucacuu

SEQ ID NO: 3541 - DNA, 21 bp, Artificial Sequence
  Synthetic polynucleotide
  modified_base (1)..(21): Positions 3, 8, 11, 13-16 2'-O-methyl ribonucleotide
  modified_base (21)..(21): phosphorothioate linked nucleoside
gauagggugauguuccgaatt

SEQ ID NO: 3542 - DNA, 21 bp, Artificial Sequence
  Synthetic polynucleotide
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
gauagggugauguuccgaauu

SEQ ID NO: 3543 - DNA, 21 bp, Artificial Sequence
  Synthetic polynucleotide
  modified_base (1)..(21): Positions 1, 3, 5, 7-8, 10- 11, 13, 15, 17, 19, 21 2'-deoxy-2'-fluoro ("2'-fluoro") ribonucleotide
  modified_base (1)..(21): Positions 2, 4, 6, 9, 12, 14, 16, 18, 20 2'-O-methyl ribonucleotide
gauagggugauguuccgaauu

SEQ ID NO: 3544 - DNA, 21 bp, Artificial Sequence
  Synthetic polynucleotide
  modified_base (1)..(21): Positions 1, 3, 5, 7, 10-11, 13, 15, 17, 19, 21 2'-deoxy-2'-fluoro ("2'-fluoro") ribonucleotide
  modified_base (1)..(21): Positions 2, 4, 6, 8-9, 12, 14, 16, 18, 20 2'-O-methyl ribonucleotide
gauagggugauguuccgaauu

SEQ ID NO: 3545 - DNA, 21 bp, Artificial Sequence
  Synthetic polynucleotide
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
gauagggugauguuccgaauu

SEQ ID NO: 3546 - DNA, 21 bp, Artificial Sequence
  Synthetic polynucleotide
  modified_base (1)..(21): Positions 1, 3, 5, 7, 9-10, 12-13, 15, 17, 19, 21 2'-deoxy-2'-fluoro ("2'-fluoro") ribonucleotide
  modified_base (1)..(21): Positions 2, 4, 6, 8, 11, 14, 16, 18, 20 2'-O-methyl ribonucleotide
gauagggugauguuccgaauu

SEQ ID NO: 3547 - DNA, 21 bp, Artificial Sequence
  Synthetic polynucleotide
  modified_base (1)..(21): Positions 1, 3, 5, 7, 9-10, 13, 15, 17, 19, 21 2'-deoxy-2'-fluoro ("2'-fluoro") ribonucleotide
  modified_base (1)..(21): Positions 2, 4, 6, 8, 11-12, 14, 16, 18, 20 2'-O-methyl ribonucleotide
gauagggugauguuccgaauu

SEQ ID NO: 3548 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
gauagggugauguuccgaauu

SEQ ID NO: 3549 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
gauagggugauguuccgaauu

SEQ ID NO: 3550 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (2)..(3): phosphorothioate linked nucleoside
gauagggugauguuccgaauu

SEQ ID NO: 3551 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
gauagggugauguuccgaauu

SEQ ID NO: 3552 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
  modified_base (2)..(3): phosphorothioate linked nucleoside
gauagggugauguuccgaauu

SEQ ID NO: 3553 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
gauagggugauguuccgaauu

SEQ ID NO: 3554 - DNA, 21 bp, Artificial Sequence
  Synthetic polynucleotide
  modified_base (1)..(21): Positions 1, 3, 5-6, 9, 11, 13, 15, 17, 19, 21 2'-deoxy-2'-fluoro ("2'-fluoro") ribonucleotide
  modified_base (1)..(21): Positions 2, 4, 7-8, 10, 12, 14, 16, 18, 20 2'-O-methyl ribonucleotide
gauagggugauguuccgaauu

SEQ ID NO: 3555 - DNA, 21 bp, Artificial Sequence
  Synthetic polynucleotide
  modified_base (1)..(21): Positions 1, 3, 6-7, 9, 11, 13, 15, 17, 19, 21 2'-deoxy-2'-fluoro ("2'-fluoro") ribonucleotide
  modified_base (1)..(21): Positions 2, 4-5, 8, 10, 12, 14, 16, 18, 20 2'-O-methyl ribonucleotide
gauagggugauguuccgaauu

SEQ ID NO: 3556 - DNA, 21 bp, Artificial Sequence
  Synthetic polynucleotide
  modified_base (1)..(21): Positions 1, 3-4, 7, 9, 11, 13, 15, 17, 19, 21 2'-deoxy-2'-fluoro ("2'-fluoro") ribonucleotide
  modified_base (1)..(21): Positions 2, 5-6, 8, 10, 12, 14, 16, 18, 20 2'-O-methyl ribonucleotide
gauagggugauguuccgaauu

SEQ ID NO: 3557 - DNA, 21 bp, Artificial Sequence
  Synthetic polynucleotide
  modified_base (1)..(21): Positions 1, 4-5, 7, 9, 11, 13, 15, 17, 19, 21 2'-deoxy-2'-fluoro ("2'-fluoro") ribonucleotide
  modified_base (1)..(21): Positions 2-3, 6, 8, 10, 12, 14, 16, 18, 20 2'-O-methyl ribonucleotide
gauagggugauguuccgaauu

SEQ ID NO: 3558 - DNA, 21 bp, Artificial Sequence
  Synthetic polynucleotide
  modified_base (1)..(21): Positions 1-2, 5, 7, 9, 11, 13, 15, 17, 19, 21 2'-deoxy-2'-fluoro ("2'-fluoro") ribonucleotide
  modified_base (1)..(21): Positions 3-4, 6, 8, 10, 12, 14, 16, 18, 20 2'-O-methyl ribonucleotide
gauagggugauguuccgaauu

SEQ ID NO: 3559 - DNA, 21 bp, Artificial Sequence
  Synthetic polynucleotide
  modified_base (1)..(21): Positions 2-3, 5, 7, 9, 11, 13, 15, 17, 19, 21 2'-deoxy-2'-fluoro ("2'-fluoro") ribonucleotide
  modified_base (1)..(21): Positions 1, 4, 6, 8, 10, 12, 14, 16, 18, 20 2'-O-methyl ribonucleotide
gauagggugauguuccgaauu

SEQ ID NO: 3560 - DNA, 21 bp, Artificial Sequence
  Synthetic polynucleotide
  modified_base (1)..(21): Positions 3, 5, 7, 9, 11, 13, 15, 17, 19, 21 2'-deoxy-2'-fluoro ("2'-fluoro") ribonucleotide
  modified_base (1)..(21): Positions 1-2, 4, 6, 8, 10, 12, 14, 16, 18, 20 2'-O-methyl ribonucleotide
gauagggugauguuccgaauu

SEQ ID NO: 3561 - DNA, 21 bp, Artificial Sequence
  Synthetic polynucleotide
  modified_base (1)..(21): Positions 1, 3, 5, 7, 9, 11, 14-15, 17, 19, 21 2'-deoxy-2'-fluoro ("2'-fluoro") ribonucleotide
  modified_base (1)..(21): Positions 2, 4, 6, 8, 10, 12-13, 16, 18, 20 2'-O-methyl ribonucleotide
gauagggugauguuccgaauu

SEQ ID NO: 3562 - DNA, 21 bp, Artificial Sequence
  Synthetic polynucleotide
  modified_base (1)..(21): Positions 1, 3, 5, 7, 9, 11, 13-14, 17, 19, 21 2'-deoxy-2'-fluoro ("2'-fluoro") ribonucleotide
  modified_base (1)..(21): Positions 2, 4, 6, 8, 10, 12, 15-16, 18, 20 2'-O-methyl ribonucleotide
gauagggugauguuccgaauu

SEQ ID NO: 3563 - DNA, 21 bp, Artificial Sequence
  Synthetic polynucleotide
  modified_base (1)..(21): Positions 1, 3, 5, 7, 9, 11, 13, 16-17, 19, 21 2'-deoxy-2'-fluoro ("2'-fluoro") ribonucleotide
  modified_base (1)..(21): Positions 2, 4, 6, 8, 10, 12, 14-15, 18, 20 2'-O-methyl ribonucleotide
gauagggugauguuccgaauu

SEQ ID NO: 3564 - DNA, 21 bp, Artificial Sequence
  Synthetic polynucleotide
  modified_base (1)..(21): Positions 1, 3, 5, 7, 9, 11, 13, 15-16, 19, 21 2'-deoxy-2'-fluoro ("2'-fluoro") ribonucleotide
  modified_base (1)..(21): Positions 2, 4, 6, 8, 10, 12, 14, 17-18, 20 2'-O-methyl ribonucleotide
gauagggugauguuccgaauu

SEQ ID NO: 3565 - DNA, 21 bp, Artificial Sequence
  Synthetic polynucleotide
  modified_base (1)..(21): Positions 1, 3, 5, 7, 9, 11, 13, 15, 18-19, 21 2'-deoxy-2'-fluoro ("2'-fluoro") ribonucleotide
  modified_base (1)..(21): Positions 2, 4, 6, 8, 10, 12, 14, 16-17, 20 2'-O-methyl ribonucleotide
gauagggugauguuccgaauu

SEQ ID NO: 3566 - DNA, 21 bp, Artificial Sequence
  Synthetic polynucleotide
  modified_base (1)..(21): Positions 1, 3, 5, 7, 9, 11, 13, 15, 17-18, 21 2'-deoxy-2'-fluoro ("2'-fluoro") ribonucleotide
  modified_base (1)..(21): Positions 2, 4, 6, 8, 10, 12, 14, 16, 19-20 2'-O-methyl ribonucleotide
gauagggugauguuccgaauu

SEQ ID NO: 3567 - DNA, 21 bp, Artificial Sequence
  Synthetic polynucleotide
  modified_base (1)..(21): Positions 1, 3, 5, 7, 9, 11, 13, 15, 17, 20-21 2'-deoxy-2'-fluoro ("2'-fluoro") ribonucleotide
  modified_base (1)..(21): Positions 2, 4, 6, 8, 10, 12, 14, 16, 18-19 2'-O-methyl ribonucleotide
gauagggugauguuccgaauu

SEQ ID NO: 3568 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
gauagggugauguuccgaauu

SEQ ID NO: 3569 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
gauagggugauguuccgaauu

SEQ ID NO: 3570 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
gauagggugauguuccgaauu

SEQ ID NO: 3571 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
gauagggugauguuccgaauu

SEQ ID NO: 3572 - DNA, 21 bp, Artificial Sequence
  Synthetic polynucleotide
  modified_base (1)..(21): Positions 2, 5-7, 9, 13-14, 16-17, 19 2'-O-methyl ribonucleotide
  modified_base (21)..(21): phosphorothioate linked nucleoside
gcaguuugcagguuaucautt

SEQ ID NO: 3573 - DNA, 21 bp, Artificial Sequence
  Synthetic polynucleotide
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
gcaguuugcagguuaucauuu

SEQ ID NO: 3574 - DNA, 21 bp, Artificial Sequence
  Synthetic polynucleotide
  modified_base (1)..(21): Positions 1, 3, 5, 7-8, 10-11, 13, 15, 17, 19, 21 2'-deoxy-2'-fluoro ("2'-fluoro") ribonucleotide
  modified_base (1)..(21): Positions 2, 4, 6, 9, 12, 14, 16, 18, 20 2'-O-methyl ribonucleotide
gcaguuugcagguuaucauuu

SEQ ID NO: 3575 - DNA, 21 bp, Artificial Sequence
  Synthetic polynucleotide
  modified_base (1)..(21): Positions 1, 3, 5, 7, 10-11, 13, 15, 17, 19, 21 2'-deoxy-2'-fluoro ("2'-fluoro") ribonucleotide
  modified_base (1)..(21): Positions 2, 4, 6, 8-9, 12, 14, 16, 18, 20 2'-O-methyl ribonucleotide
gcaguuugcagguuaucauuu

SEQ ID NO: 3576 - DNA, 21 bp, Artificial Sequence
  Synthetic polynucleotide
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
gcaguuugcagguuaucauuu

SEQ ID NO: 3577 - DNA, 21 bp, Artificial Sequence
  Synthetic polynucleotide
  modified_base (1)..(21): Positions 1, 3, 5, 7, 9-10, 12-13, 15, 17, 19, 21 2'-deoxy-2'-fluoro ("2'-fluoro") ribonucleotide
  modified_base (1)..(21): Positions 2, 4, 6, 8, 11, 14, 16, 18, 20 2'-O-methyl ribonucleotide
gcaguuugcagguuaucauuu

SEQ ID NO: 3578 - DNA, 21 bp, Artificial Sequence
  Synthetic polynucleotide
  modified_base (1)..(21): Positions 1, 3, 5, 7, 9-10, 13, 15, 17, 19, 21 2'-deoxy-2'-fluoro ("2'-fluoro") ribonucleotide
  modified_base (1)..(21): Positions 2, 4, 6, 8, 11-12, 14, 16, 18, 20 2'-O-methyl ribonucleotide
gcaguuugcagguuaucauuu

SEQ ID NO: 3579 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
gcaguuugcagguuaucauuu

SEQ ID NO: 3580 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
gcaguuugcagguuaucauuu

SEQ ID NO: 3581 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (2)..(3): phosphorothioate linked nucleoside
gcaguuugcagguuaucauuu

SEQ ID NO: 3582 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
gcaguuugcagguuaucauuu

SEQ ID NO: 3583 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
  modified_base (2)..(3): phosphorothioate linked nucleoside
gcaguuugcagguuaucauuu

SEQ ID NO: 3584 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
gcaguuugcagguuaucauuu

SEQ ID NO: 3585 - DNA, 21 bp, Artificial Sequence
  Synthetic polynucleotide
  modified_base (1)..(21): Positions 1, 3, 5-6, 9, 11, 13, 15, 17, 19, 21 2'-deoxy-2'-fluoro ("2'-fluoro") ribonucleotide
  modified_base (1)..(21): Positions 2, 4, 7-8, 10, 12, 14, 16, 18, 20 2'-O-methyl ribonucleotide
gcaguuugcagguuaucauuu

SEQ ID NO: 3586 - DNA, 21 bp, Artificial Sequence
  Synthetic polynucleotide
  modified_base (1)..(21): Positions 1, 3, 6-7, 9, 11, 13, 15, 17, 19, 21 2'-deoxy-2'-fluoro ("2'-fluoro") ribonucleotide
  modified_base (1)..(21): Positions 2, 4-5, 8, 10, 12, 14, 16, 18, 20 2'-O-methyl ribonucleotide
gcaguuugcagguuaucauuu

SEQ ID NO: 3587 - DNA, 21 bp, Artificial Sequence
  Synthetic polynucleotide
  modified_base (1)..(21): Positions 1, 3-4, 7, 9, 11, 13, 15, 17, 19, 21 2'-deoxy-2'-fluoro ("2'-fluoro") ribonucleotide
  modified_base (1)..(21): Positions 2, 5-6, 8, 10, 12, 14, 16, 18, 20 2'-O-methyl ribonucleotide
gcaguuugcagguuaucauuu

SEQ ID NO: 3588 - DNA, 21 bp, Artificial Sequence
  Synthetic polynucleotide
  modified_base (1)..(21): Positions 1, 4-5, 7, 9, 11, 13, 15, 17, 19, 21 2'-deoxy-2'-fluoro ("2'-fluoro") ribonucleotide
  modified_base (1)..(21): Positions 2-3, 6, 8, 10, 12, 14, 16, 18, 20 2'-O-methyl ribonucleotide
gcaguuugcagguuaucauuu

SEQ ID NO: 3589 - DNA, 21 bp, Artificial Sequence
  Synthetic polynucleotide
  modified_base (1)..(21): Positions 1-2, 5, 7, 9, 11, 13, 15, 17, 19, 21 2'-deoxy-2'-fluoro ("2'-fluoro") ribonucleotide
  modified_base (1)..(21): Positions 3-4, 6, 8, 10, 12, 14, 16, 18, 20 2'-O-methyl ribonucleotide
gcaguuugcagguuaucauuu

SEQ ID NO: 3590 - DNA, 21 bp, Artificial Sequence
  Synthetic polynucleotide
  modified_base (1)..(21): Positions 2-3, 5, 7, 9, 11, 13, 15, 17, 19, 21 2'-deoxy-2'-fluoro ("2'-fluoro") ribonucleotide
  modified_base (1)..(21): Positions 1, 4, 6, 8, 10, 12, 14, 16, 18, 20 2'-O-methyl ribonucleotide
gcaguuugcagguuaucauuu

SEQ ID NO: 3591 - DNA, 21 bp, Artificial Sequence
  Synthetic polynucleotide
  modified_base (1)..(21): Positions 3, 5, 7, 9, 11, 13, 15, 17, 19, 21 2'-deoxy-2'-fluoro ("2'-fluoro") ribonucleotide
  modified_base (1)..(21): Positions 1-2, 4, 6, 8, 10, 12, 14, 16, 18, 20 2'-O-methyl ribonucleotide
gcaguuugcagguuaucauuu

SEQ ID NO: 3592 - DNA, 21 bp, Artificial Sequence
  Synthetic polynucleotide
  modified_base (1)..(21): Positions 1, 3, 5, 7, 9, 11, 14-15, 17, 19, 21 2'-deoxy-2'-fluoro ("2'-fluoro") ribonucleotide
  modified_base (1)..(21): Positions 2, 4, 6, 8, 10, 12-13, 16, 18, 20 2'-O-methyl ribonucleotide
gcaguuugcagguuaucauuu

SEQ ID NO: 3593 - DNA, 21 bp, Artificial Sequence
  Synthetic polynucleotide
  modified_base (1)..(21): Positions 1, 3, 5, 7, 9, 11, 13-14, 17, 19, 21 2'-deoxy-2'-fluoro ("2'-fluoro") ribonucleotide
  modified_base (1)..(21): Positions 2, 4, 6, 8, 10, 12, 15-16, 18, 20 2'-O-methyl ribonucleotide
gcaguuugcagguuaucauuu

SEQ ID NO: 3594 - DNA, 21 bp, Artificial Sequence
  Synthetic polynucleotide
  modified_base (1)..(21): Positions 1, 3, 5, 7, 9, 11, 13, 16-17, 19, 21 2'-deoxy-2'-fluoro ("2'-fluoro") ribonucleotide
  modified_base (1)..(21): Positions 2, 4, 6, 8, 10, 12, 14-15, 18, 20 2'-O-methyl ribonucleotide
gcaguuugcagguuaucauuu

SEQ ID NO: 3595 - DNA, 21 bp, Artificial Sequence
  Synthetic polynucleotide
  modified_base (1)..(21): Positions 1, 3, 5, 7, 9, 11, 13, 15-16, 19, 21 2'-deoxy-2'-fluoro ("2'-fluoro") ribonucleotide
  modified_base (1)..(21): Positions 2, 4, 6, 8, 10, 12, 14, 17-18, 20 2'-O-methyl ribonucleotide
gcaguuugcagguuaucauuu

SEQ ID NO: 3596 - DNA, 21 bp, Artificial Sequence
  Synthetic polynucleotide
  modified_base (1)..(21): Positions 1, 3, 5, 7, 9, 11, 13, 15, 18-19, 21 2'-deoxy-2'-fluoro ("2'-fluoro") ribonucleotide
  modified_base (1)..(21): Positions 2, 4, 6, 8, 10, 12, 14, 16-17, 20 2'-O-methyl ribonucleotide
gcaguuugcagguuaucauuu

SEQ ID NO: 3597 - DNA, 21 bp, Artificial Sequence
  Synthetic polynucleotide
  modified_base (1)..(21): Positions 1, 3, 5, 7, 9, 11, 13, 15, 17-18, 21 2'-deoxy-2'-fluoro ("2'-fluoro") ribonucleotide
  modified_base (1)..(21): Positions 2, 4, 6, 8, 10, 12, 14, 16, 19-20 2'-O-methyl ribonucleotide
gcaguuugcagguuaucauuu

SEQ ID NO: 3598 - DNA, 21 bp, Artificial Sequence
  Synthetic polynucleotide
  modified_base (1)..(21): Positions 1, 3, 5, 7, 9, 11, 13, 15, 17, 20-21 2'-deoxy-2'-fluoro ("2'-fluoro") ribonucleotide
  modified_base (1)..(21): Positions 2, 4, 6, 8, 10, 12, 14, 16, 18-19 2'-O-methyl ribonucleotide
gcaguuugcagguuaucauuu

SEQ ID NO: 3599 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
gcaguuugcagguuaucauuu

SEQ ID NO: 3600 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
gcaguuugcagguuaucauuu

SEQ ID NO: 3601 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
gcaguuugcagguuaucauuu

SEQ ID NO: 3602 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
gcaguuugcagguuaucauuu

SEQ ID NO: 3603 - DNA, 21 bp, Artificial Sequence
  Synthetic polynucleotide
  modified_base (1)..(21): Positions 3-4, 6-8, 10, 12, 15-16 2'-O-methyl ribonucleotide
  modified_base (21)..(21): phosphorothioate linked nucleoside
gguugucugugugaucggdtt

SEQ ID NO: 3604 - DNA, 21 bp, Artificial Sequence
  Synthetic polynucleotide
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
gguugucugugugaucggauu

SEQ ID NO: 3605 - DNA, 21 bp, Artificial Sequence
  Synthetic polynucleotide
  modified_base (1)..(21): Positions 1, 3, 5, 7-8, 10-11, 13, 15, 17, 19, 21 2'-deoxy-2'-fluoro ("2'-fluoro") ribonucleotide
  modified_base (1)..(21): Positions 2, 4, 6, 9, 12, 14, 16, 18, 20 2'-O-methyl ribonucleotide
gguugucugugugaucggauu

SEQ ID NO: 3606 - DNA, 21 bp, Artificial Sequence
  Synthetic polynucleotide
  modified_base (1)..(21): Positions 1, 3, 5, 7, 10-11, 13, 15, 17, 19, 21 2'-deoxy-2'-fluoro ("2'-fluoro") ribonucleotide
  modified_base (1)..(21): Positions 2, 4, 6, 8-9, 12, 14, 16, 18, 20 2'-O-methyl ribonucleotide
gguugucugugugaucggauu

SEQ ID NO: 3607 - DNA, 21 bp, Artificial Sequence
  Synthetic polynucleotide
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
gguugucugugugaucggauu

SEQ ID NO: 3608 - DNA, 21 bp, Artificial Sequence
  Synthetic polynucleotide
  modified_base (1)..(21): Positions 1, 3, 5, 7, 9-10, 12-13, 15, 17, 19, 21 2'-deoxy-2'-fluoro ("2'-fluoro") ribonucleotide
  modified_base (1)..(21): Positions 2, 4, 6, 8, 11, 14, 16, 18, 20 2'-O-methyl ribonucleotide
gguugucugugugaucggauu

SEQ ID NO: 3609 - DNA, 21 bp, Artificial Sequence
  Synthetic polynucleotide
  modified_base (1)..(21): Positions 1, 3, 5, 7, 9-10, 13, 15, 17, 19, 21 2'-deoxy-2'-fluoro ("2'-fluoro") ribonucleotide
  modified_base (1)..(21): Positions 2, 4, 6, 8, 11-12, 14, 16, 18, 20 2'-O-methyl ribonucleotide
gguugucugugugaucggauu

SEQ ID NO: 3610 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
gguugucugugugaucggauu

SEQ ID NO: 3611 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
gguugucugugugaucggauu

SEQ ID NO: 3612 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (2)..(3): phosphorothioate linked nucleoside
gguugucugugugaucggauu

SEQ ID NO: 3613 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
gguugucugugugaucggauu

SEQ ID NO: 3614 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
  modified_base (2)..(3): phosphorothioate linked nucleoside
gguugucugugugaucggauu

SEQ ID NO: 3615 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
gguugucugugugaucggauu

SEQ ID NO: 3616 - DNA, 21 bp, Artificial Sequence
  Synthetic polynucleotide
  modified_base (1)..(21): Positions 1, 3, 5-6, 9, 11, 13, 15, 17, 19, 21 2'-deoxy-2'-fluoro ("2'-fluoro") ribonucleotide
  modified_base (1)..(21): Positions 2, 4, 7-8, 10, 12, 14, 16, 18, 20 2'-O-methyl ribonucleotide
gguugucugugugaucggauu

SEQ ID NO: 3617 - DNA, 21 bp, Artificial Sequence
  Synthetic polynucleotide
  modified_base (1)..(21): Positions 1, 3, 6-7, 9, 11, 13, 15, 17, 19, 21 2'-deoxy-2'-fluoro ("2'-fluoro") ribonucleotide
  modified_base (1)..(21): Positions 2, 4-5, 8, 10, 12, 14, 16, 18, 20 2'-O-methyl ribonucleotide
gguugucugugugaucggauu

SEQ ID NO: 3618 - DNA, 21 bp, Artificial Sequence
  Synthetic polynucleotide
  modified_base (1)..(21): Positions 1, 3-4, 7, 9, 11, 13, 15, 17, 19, 21 2'-deoxy-2'-fluoro ("2'-fluoro") ribonucleotide
  modified_base (1)..(21): Positions 2, 5-6, 8, 10, 12, 14, 16, 18, 20 2'-O-methyl ribonucleotide
gguugucugugugaucggauu

SEQ ID NO: 3619 - DNA, 21 bp, Artificial Sequence
  Synthetic polynucleotide
  modified_base (1)..(21): Positions 1, 4-5, 7, 9, 11, 13, 15, 17, 19, 21 2'-deoxy-2'-fluoro ("2'-fluoro") ribonucleotide
  modified_base (1)..(21): Positions 2-3, 6, 8, 10, 12, 14, 16, 18, 20 2'-O-methyl ribonucleotide
gguugucugugugaucggauu

SEQ ID NO: 3620 - DNA, 21 bp, Artificial Sequence
  Synthetic polynucleotide
  modified_base (1)..(21): Positions 1-2, 5, 7, 9, 11, 13, 15, 17, 19, 21 2'-deoxy-2'-fluoro ("2'-fluoro") ribonucleotide
  modified_base (1)..(21): Positions 3-4, 6, 8, 10, 12, 14, 16, 18, 20 2'-O-methyl ribonucleotide
gguugucugugugaucggauu

SEQ ID NO: 3621 - DNA, 21 bp, Artificial Sequence
  Synthetic polynucleotide
  modified_base (1)..(21): Positions 2-3, 5, 7, 9, 11, 13, 15, 17, 19, 21 2'-deoxy-2'-fluoro ("2'-fluoro") ribonucleotide
  modified_base (1)..(21): Positions 1, 4, 6, 8, 10, 12, 14, 16, 18, 20 2'-O-methyl ribonucleotide
gguugucugugugaucggauu

SEQ ID NO: 3622 - DNA, 21 bp, Artificial Sequence
  Synthetic polynucleotide
  modified_base (1)..(21): Positions 3, 5, 7, 9, 11, 13, 15, 17, 19, 21 2'-deoxy-2'-fluoro ("2'-fluoro") ribonucleotide
  modified_base (1)..(21): Positions 1-2, 4, 6, 8, 10, 12, 14, 16, 18, 20 2'-O-methyl ribonucleotide
gguugucugugugaucggauu

SEQ ID NO: 3623 - DNA, 21 bp, Artificial Sequence
  Synthetic polynucleotide
  modified_base (1)..(21): Positions 1, 3, 5, 7, 9, 11, 14-15, 17, 19, 21 2'-deoxy-2'-fluoro ("2'-fluoro") ribonucleotide
  modified_base (1)..(21): Positions 2, 4, 6, 8, 10, 12-13, 16, 18, 20 2'-O-methyl ribonucleotide
gguugucugugugaucggauu

SEQ ID NO: 3624 - DNA, 21 bp, Artificial Sequence
  Synthetic polynucleotide
  modified_base (1)..(21): Positions 1, 3, 5, 7, 9, 11, 13-14, 17, 19, 21 2'-deoxy-2'-fluoro ("2'-fluoro") ribonucleotide
  modified_base (1)..(21): Positions 2, 4, 6, 8, 10, 12, 15-16, 18, 20 2'-O-methyl ribonucleotide
gguugucugugugaucggauu

SEQ ID NO: 3625 - DNA, 21 bp, Artificial Sequence
  Synthetic polynucleotide
  modified_base (1)..(21): Positions 1, 3, 5, 7, 9, 11, 13, 16-17, 19, 21 2'-deoxy-2'-fluoro ("2'-fluoro") ribonucleotide
  modified_base (1)..(21): Positions 2, 4, 6, 8, 10, 12, 14-15, 18, 20 2'-O-methyl ribonucleotide
gguugucugugugaucggauu

SEQ ID NO: 3626 - DNA, 21 bp, Artificial Sequence
  Synthetic polynucleotide
  modified_base (1)..(21): Positions 1, 3, 5, 7, 9, 11, 13, 15-16, 19, 21 2'-deoxy-2'-fluoro ("2'-fluoro") ribonucleotide
  modified_base (1)..(21): Positions 2, 4, 6, 8, 10, 12, 14, 17-18, 20 2'-O-methyl ribonucleotide
gguugucugugugaucggauu

SEQ ID NO: 3627 - DNA, 21 bp, Artificial Sequence
  Synthetic polynucleotide
  modified_base (1)..(21): Positions 1, 3, 5, 7, 9, 11, 13, 15, 18-19, 21 2'-deoxy-2'-fluoro ("2'-fluoro") ribonucleotide
  modified_base (1)..(21): Positions 2, 4, 6, 8, 10, 12, 14, 16-17, 20 2'-O-methyl ribonucleotide
gguugucugugugaucggauu

SEQ ID NO: 3628 - DNA, 21 bp, Artificial Sequence
  Synthetic polynucleotide
  modified_base (1)..(21): Positions 1, 3, 5, 7, 9, 11, 13, 15, 17-18, 21 2'-deoxy-2'-fluoro ("2'-fluoro") ribonucleotide
  modified_base (1)..(21): Positions 2, 4, 6, 8, 10, 12, 14, 16, 19-20 2'-O-methyl ribonucleotide
gguugucugugugaucggauu

SEQ ID NO: 3629 - DNA, 21 bp, Artificial Sequence
  Synthetic polynucleotide
  modified_base (1)..(21): Positions 1, 3, 5, 7, 9, 11, 13, 15, 17, 20-21 2'-deoxy-2'-fluoro ("2'-fluoro") ribonucleotide
  modified_base (1)..(21): Positions 2, 4, 6, 8, 10, 12, 14, 16, 18-19 2'-O-methyl ribonucleotide
gguugucugugugaucggauu

SEQ ID NO: 3630 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
gguugucugugugaucggauu

SEQ ID NO: 3631 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
gguugucugugugaucggauu

SEQ ID NO: 3632 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19, 20-21 2'-O-methyl ribonucleotide
gguugucugugugaucggauu

SEQ ID NO: 3633 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
gguugucugugugaucggauu

SEQ ID NO: 3634 - DNA, 21 bp, Artificial Sequence
  Synthetic polynucleotide
  modified_base (1)..(21): Positions 1, 5-6, 8, 13, 17-19 2'-O-methyl ribonucleotide
  modified_base (21)..(21): phosphorothioate linked nucleoside
cggacuacgagacgggcuutt

SEQ ID NO: 3635 - DNA, 21 bp, Artificial Sequence
  Synthetic polynucleotide
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
cggacuacgagacgggcuuuu

SEQ ID NO: 3636 - DNA, 21 bp, Artificial Sequence
  Synthetic polynucleotide
  modified_base (1)..(21): Positions 1, 3, 5, 7-8, 10-11, 13, 15, 17, 19, 21 2'-deoxy-2'-fluoro ("2'-fluoro") ribonucleotide
  modified_base (1)..(21): Positions 2, 4, 6, 9, 12, 14, 16, 18, 20 2'-O-methyl ribonucleotide
cggacuacgagacgggcuuuu

SEQ ID NO: 3637 - DNA, 21 bp, Artificial Sequence
  Synthetic polynucleotide
  modified_base (1)..(21): Positions 1, 3, 5, 7, 10-11, 13, 15, 17, 19, 21 2'-deoxy-2'-fluoro ("2'-fluoro") ribonucleotide
  modified_base (1)..(21): Positions 2, 4, 6, 8-9, 12, 14, 16, 18, 20 2'-O-methyl ribonucleotide
cggacuacgagacgggcuuuu

SEQ ID NO: 3638 - DNA, 21 bp, Artificial Sequence
  Synthetic polynucleotide
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
cggacuacgagacgggcuuuu

SEQ ID NO: 3639 - DNA, 21 bp, Artificial Sequence
  Synthetic polynucleotide
  modified_base (1)..(21): Positions 1, 3, 5, 7, 9-10, 12-13, 15, 17, 19, 21 2'-deoxy-2'-fluoro ("2'-fluoro") ribonucleotide
  modified_base (1)..(21): Positions 2, 4, 6, 8, 11, 14, 16, 18, 20 2'-O-methyl ribonucleotide
cggacuacgagacgggcuuuu

SEQ ID NO: 3640 - DNA, 21 bp, Artificial Sequence
  Synthetic polynucleotide
  modified_base (1)..(21): Positions 1, 3, 5, 7, 9-10, 13, 15, 17, 19, 21 2'-deoxy-2'-fluoro ("2'-fluoro") ribonucleotide
  modified_base (1)..(21): Positions 2, 4, 6, 8, 11-12, 14, 16, 18, 20 2'-O-methyl ribonucleotide
cggacuacgagacgggcuuuu

SEQ ID NO: 3641 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
cggacuacgagacgggcuuuu

SEQ ID NO: 3642 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
cggacuacgagacgggcuuuu

SEQ ID NO: 3643 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (2)..(3): phosphorothioate linked nucleoside
cggacuacgagacgggcuuuu

SEQ ID NO: 3644 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
cggacuacgagacgggcuuuu

SEQ ID NO: 3645 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
  modified_base (2)..(3): phosphorothioate linked nucleoside
cggacuacgagacgggcuuuu

SEQ ID NO: 3646 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
cggacuacgagacgggcuuuu

SEQ ID NO: 3647 - DNA, 21 bp, Artificial Sequence
  Synthetic polynucleotide
  modified_base (1)..(21): Positions 1, 3, 5-6, 9, 11, 13, 15, 17, 19, 21 2'-deoxy-2'-fluoro ("2'-fluoro") ribonucleotide
  modified_base (1)..(21): Positions 2, 4, 7-8, 10, 12, 14, 16, 18, 20 2'-O-methyl ribonucleotide
cggacuacgagacgggcuuuu

SEQ ID NO: 3648 - DNA, 21 bp, Artificial Sequence
  Synthetic polynucleotide
  modified_base (1)..(21): Positions 1, 3, 6-7, 9, 11, 13, 15, 17, 19, 21 2'-deoxy-2'-fluoro ("2'-fluoro") ribonucleotide
  modified_base (1)..(21): Positions 2, 4-5, 8, 10, 12, 14, 16, 18, 20 2'-O-methyl ribonucleotide
cggacuacgagacgggcuuuu

SEQ ID NO: 3649 - DNA, 21 bp, Artificial Sequence
  Synthetic polynucleotide
  modified_base (1)..(21): Positions 1, 3-4, 7, 9, 11, 13, 15, 17, 19, 21 2'-deoxy-2'-fluoro ("2'-fluoro") ribonucleotide
  modified_base (1)..(21): Positions 2, 5-6, 8, 10, 12, 14, 16, 18, 20 2'-O-methyl ribonucleotide
cggacuacgagacgggcuuuu

SEQ ID NO: 3650 - DNA, 21 bp, Artificial Sequence
  Synthetic polynucleotide
  modified_base (1)..(21): Positions 1, 4-5, 7, 9, 11, 13, 15, 17, 19, 21 2'-deoxy-2'-fluoro ("2'-fluoro") ribonucleotide
  modified_base (1)..(21): Positions 2-3, 6, 8, 10, 12, 14, 16, 18, 20 2'-O-methyl ribonucleotide
cggacuacgagacgggcuuuu

SEQ ID NO: 3651 - DNA, 21 bp, Artificial Sequence
  Synthetic polynucleotide
  modified_base (1)..(21): Positions 1-2, 5, 7, 9, 11, 13, 15, 17, 19, 21 2'-deoxy-2'-fluoro ("2'-fluoro") ribonucleotide
  modified_base (1)..(21): Positions 3-4, 6, 8, 10, 12, 14, 16, 18, 20 2'-O-methyl ribonucleotide
cggacuacgagacgggcuuuu

SEQ ID NO: 3652 - DNA, 21 bp, Artificial Sequence
  Synthetic polynucleotide
  modified_base (1)..(21): Positions 2-3, 5, 7, 9, 11, 13, 15, 17, 19, 21 2'-deoxy-2'-fluoro ("2'-fluoro") ribonucleotide
  modified_base (1)..(21): Positions 1, 4, 6, 8, 10, 12, 14, 16, 18, 20 2'-O-methyl ribonucleotide
cggacuacgagacgggcuuuu

SEQ ID NO: 3653 - DNA, 21 bp, Artificial Sequence
  Synthetic polynucleotide
  modified_base (1)..(21): Positions 3, 5, 7, 9, 11, 13, 15, 17, 19, 21 2'-deoxy-2'-fluoro ("2'-fluoro") ribonucleotide
  modified_base (1)..(21): Positions 1-2, 4, 6, 8, 10, 12, 14, 16, 18, 20 2'-O-methyl ribonucleotide
cggacuacgagacgggcuuuu

SEQ ID NO: 3654 - DNA, 21 bp, Artificial Sequence
  Synthetic polynucleotide
  modified_base (1)..(21): Positions 1, 3, 5, 7, 9, 11, 14-15, 17, 19, 21 2'-deoxy-2'-fluoro ("2'-fluoro") ribonucleotide
  modified_base (1)..(21): Positions 2, 4, 6, 8, 10, 12-13, 16, 18, 20 2'-O-methyl ribonucleotide
cggacuacgagacgggcuuuu

SEQ ID NO: 3655 - DNA, 21 bp, Artificial Sequence
  Synthetic polynucleotide
  modified_base (1)..(21): Positions 1, 3, 5, 7, 9, 11, 13-14, 17, 19, 21 2'-deoxy-2'-fluoro ("2'-fluoro") ribonucleotide
  modified_base (1)..(21): Positions 2, 4, 6, 8, 10, 12, 15-16, 18, 20 2'-O-methyl ribonucleotide
cggacuacgagacgggcuuuu

SEQ ID NO: 3656 - DNA, 21 bp, Artificial Sequence
  Synthetic polynucleotide
  modified_base (1)..(21): Positions 1, 3, 5, 7, 9, 11, 13, 16-17, 19, 21 2'-deoxy-2'-fluoro ("2'-fluoro") ribonucleotide
  modified_base (1)..(21): Positions 2, 4, 6, 8, 10, 12, 14-15, 18, 20 2'-O-methyl ribonucleotide
cggacuacgagacgggcuuuu

SEQ ID NO: 3657 - DNA, 21 bp, Artificial Sequence
  Synthetic polynucleotide
  modified_base (1)..(21): Positions 1, 3, 5, 7, 9, 11, 13, 15-16, 19, 21 2'-deoxy-2'-fluoro ("2'-fluoro") ribonucleotide
  modified_base (1)..(21): Positions 2, 4, 6, 8, 10, 12, 14, 17-18, 20 2'-O-methyl ribonucleotide
cggacuacgagacgggcuuuu

SEQ ID NO: 3658 - DNA, 21 bp, Artificial Sequence
  Synthetic polynucleotide
  modified_base (1)..(21): Positions 1, 3, 5, 7, 9, 11, 13, 15, 18-19, 21 2'-deoxy-2'-fluoro ("2'-fluoro") ribonucleotide
  modified_base (1)..(21): Positions 2, 4, 6, 8, 10, 12, 14, 16-17, 20 2'-O-methyl ribonucleotide
cggacuacgagacgggcuuuu

SEQ ID NO: 3659 - DNA, 21 bp, Artificial Sequence
  Synthetic polynucleotide
  modified_base (1)..(21): Positions 1, 3, 5, 7, 9, 11, 13, 15, 17-18, 21 2'-deoxy-2'-fluoro ("2'-fluoro") ribonucleotide
  modified_base (1)..(21): Positions 2, 4, 6, 8, 10, 12, 14, 16, 19-20 2'-O-methyl ribonucleotide
cggacuacgagacgggcuuuu

SEQ ID NO: 3660 - DNA, 21 bp, Artificial Sequence
  Synthetic polynucleotide
  modified_base (1)..(21): Positions 1, 3, 5, 7, 9, 11, 13, 15, 17, 20-21 2'-deoxy-2'-fluoro ("2'-fluoro") ribonucleotide
  modified_base (1)..(21): Positions 2, 4, 6, 8, 10, 12, 14, 16, 18-19 2'-O-methyl ribonucleotide
cggacuacgagacgggcuuuu

SEQ ID NO: 3661 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4,7- 8, 11-12, 15-16, 19-20 2'-O-methyl ribonucleotide
cggacuacgagacgggcuuuu

SEQ ID NO: 3662 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
cggacuacgagacgggcuuuu

SEQ ID NO: 3663 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
cggacuacgagacgggcuuuu

SEQ ID NO: 3664 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
cggacuacgagacgggcuuuu

SEQ ID NO: 3665 - DNA, 21 bp, Artificial Sequence
  Synthetic polynucleotide
  modified_base (1)..(21): Positions 6, 12 2'-O-methyl ribonucleotide
  modified_base (21)..(21): phosphorothioate linked nucleoside
agacccagcgguagggccutt

SEQ ID NO: 3666 - DNA, 21 bp, Artificial Sequence
  Synthetic polynucleotide
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (20)..(21): phosphorothioate linked nucleoside
agacccagcgguagggccuuu

SEQ ID NO: 3667 - DNA, 21 bp, Artificial Sequence
  Synthetic polynucleotide
  modified_base (1)..(21): Positions 2, 4, 6, 8, 11, 14, 16, 18, 20 2'-deoxy-2'-fluoro ("2'-fluoro") ribonucleotide
  modified_base (1)..(21): Positions 1, 3, 5, 7, 9-10, 12-13, 15, 17, 19, 21 2'-O-methyl ribonucleotide
  modified_base (20)..(21): phosphorothioate linked nucleoside
agacccagcgguagggccuuu

SEQ ID NO: 3668 - DNA, 21 bp, Artificial Sequence
  Synthetic polynucleotide
  modified_base (1)..(21): Positions 2, 4, 6, 8, 11-12, 14, 16, 18, 20 2'-deoxy-2'-fluoro ("2'-fluoro") ribonucleotide
  modified_base (1)..(21): Positions 1, 3, 5, 7, 9-10, 13, 15, 17, 19, 21 2'-O-methyl ribonucleotide
  modified_base (20)..(21): phosphorothioate linked nucleoside
agacccagcgguagggccuuu

SEQ ID NO: 3669 - DNA, 21 bp, Artificial Sequence
  Synthetic polynucleotide
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (20)..(21): phosphorothioate linked nucleoside
agacccagcgguagggccuuu

SEQ ID NO: 3670 - DNA, 21 bp, Artificial Sequence
  Synthetic polynucleotide
  modified_base (1)..(21): Positions 2, 4, 6, 9, 12, 14, 16, 18, 20 2'-deoxy-2'-fluoro ("2'-fluoro") ribonucleotide
  modified_base (1)..(21): Positions 1, 3, 5, 7-8, 9-10, 13, 15, 17, 19, 21 2'-O-methyl ribonucleotide
  modified_base (20)..(21): phosphorothioate linked nucleoside
agacccagcgguagggccuuu

SEQ ID NO: 3671 - DNA, 21 bp, Artificial Sequence
  Synthetic polynucleotide
  modified_base (1)..(21): Positions 2, 4, 6, 8-9, 12, 14, 16, 18, 20 2'-deoxy-2'-fluoro ("2'-fluoro") ribonucleotide
  modified_base (1)..(21): Positions 1, 3, 5, 7, 10-11, 13, 15, 17, 19, 21 2'-O-methyl ribonucleotide
  modified_base (20)..(21): phosphorothioate linked nucleoside
agacccagcgguagggccuuu

SEQ ID NO: 3672 - DNA, 21 bp, Artificial Sequence
  Synthetic polynucleotide
  modified_base (1)..(21): Positions 2, 4, 6, 8, 10, 13-14, 16 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (20)..(21): phosphorothioate linked nucleoside
agacccagcgguagggccuuu

SEQ ID NO: 3673 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (20)..(21): phosphorothioate linked nucleoside
agacccagcgguagggccuuu

SEQ ID NO: 3674 - DNA, 21 bp, Artificial Sequence
  Synthetic polynucleotide
  modified_base (1)..(21): Positions 2-3, 20-21 phosphorothioate linked nucleoside
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
agacccagcgguagggccuuu

SEQ ID NO: 3675 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
agacccagcgguagggccuuu

SEQ ID NO: 3676 - DNA, 21 bp, Artificial Sequence
  Synthetic polynucleotide
  modified_base (1)..(21): Positions 2-3, 20-21 phosphorothioate linked nucleoside
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
agacccagcgguagggccuuu

SEQ ID NO: 3677 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
agacccagcgguagggccuuu

SEQ ID NO: 3678 - DNA, 21 bp, Artificial Sequence
  Synthetic polynucleotide
  modified_base (1)..(21): Positions 2, 4, 6, 8, 10, 12-13, 16, 18, 20 2'-deoxy-2'-fluoro ("2'-fluoro") ribonucleotide
  modified_base (1)..(21): Positions 1, 3, 5, 7, 9, 11, 14-15, 17, 19, 21 2'-O-methyl ribonucleotide
  modified_base (20)..(21): phosphorothioate linked nucleoside
agacccagcgguagggccuuu

SEQ ID NO: 3679 - DNA, 21 bp, Artificial Sequence
  Synthetic polynucleotide
  modified_base (1)..(21): Positions 2, 4, 6, 8, 10, 12, 15-16, 18, 20 2'-deoxy-2'-fluoro ("2'-fluoro") ribonucleotide
  modified_base (1)..(21): Positions 1, 3, 5, 7, 9, 11, 13-14, 17, 19, 21 2'-O-methyl ribonucleotide
  modified_base (20)..(21): phosphorothioate linked nucleoside
agacccagcgguagggccuuu

SEQ ID NO: 3680 - DNA, 21 bp, Artificial Sequence
  Synthetic polynucleotide
  modified_base (1)..(21): Positions 2, 4, 6, 8, 10, 12, 14-15, 18, 20 2'-deoxy-2'-fluoro ("2'-fluoro") ribonucleotide
  modified_base (1)..(21): Positions 1, 3, 5, 7, 9, 11, 13, 16-17, 19, 21 2'-O-methyl ribonucleotide
  modified_base (20)..(21): phosphorothioate linked nucleoside
agacccagcgguagggccuuu

SEQ ID NO: 3681 - DNA, 21 bp, Artificial Sequence
  Synthetic polynucleotide
  modified_base (1)..(21): Positions 2, 4, 6, 8, 10, 12, 14, 17-18, 20 2'-deoxy-2'-fluoro ("2'-fluoro") ribonucleotide
  modified_base (1)..(21): Positions 1, 3, 5, 7, 9, 11, 13, 15-16, 19, 21 2'-O-methyl ribonucleotide
  modified_base (20)..(21): phosphorothioate linked nucleoside
agacccagcgguagggccuuu

SEQ ID NO: 3682 - DNA, 21 bp, Artificial Sequence
  Synthetic polynucleotide
  modified_base (1)..(21): Positions 2, 4, 6, 8, 10, 12, 14, 16-17, 20 2'-deoxy-2'-fluoro ("2'-fluoro") ribonucleotide
  modified_base (1)..(21): Positions 1, 3, 5, 7, 9, 11, 13, 15, 18-19, 21 2'-O-methyl ribonucleotide
  modified_base (20)..(21): phosphorothioate linked nucleoside
agacccagcgguagggccuuu

SEQ ID NO: 3683 - DNA, 21 bp, Artificial Sequence
  Synthetic polynucleotide
  modified_base (1)..(21): Positions 2, 4, 6, 8, 10, 12, 14, 16, 19-20 2'-deoxy-2'-fluoro ("2'-fluoro") ribonucleotide
  modified_base (1)..(21): Positions 1, 3, 5, 7, 9, 11, 13, 15, 17-18, 21 2'-O-methyl ribonucleotide
  modified_base (20)..(21): phosphorothioate linked nucleoside
agacccagcgguagggccuuu

SEQ ID NO: 3684 - DNA, 21 bp, Artificial Sequence
  Synthetic polynucleotide
  modified_base (1)..(21): Positions 2, 4, 6, 8, 10, 12, 14, 16, 18-19 2'-deoxy-2'-fluoro ("2'-fluoro") ribonucleotide
  modified_base (1)..(21): Positions 1, 3, 5, 7, 9, 11, 13, 15, 17, 20-21 2'-O-methyl ribonucleotide
  modified_base (20)..(21): phosphorothioate linked nucleoside
agacccagcgguagggccuuu

SEQ ID NO: 3685 - DNA, 21 bp, Artificial Sequence
  Synthetic polynucleotide
  modified_base (1)..(21): Positions 2, 4, 7-8, 10, 12, 14, 16, 18, 20 2'-deoxy-2'-fluoro ("2'-fluoro") ribonucleotide
  modified_base (1)..(21): Positions 1, 3, 5-6, 9, 11, 13, 15, 17, 19, 21 2'-O-methyl ribonucleotide
  modified_base (20)..(21): phosphorothioate linked nucleoside
agacccagcgguagggccuuu

SEQ ID NO: 3686 - DNA, 21 bp, Artificial Sequence
  Synthetic polynucleotide
  modified_base (1)..(21): Positions 2, 4-5, 8, 10, 12, 14, 16, 18, 20 2'-deoxy-2'-fluoro ("2'-fluoro") ribonucleotide
  modified_base (1)..(21): Positions 1, 3, 6-7, 9, 11, 13, 15, 17, 19, 21 2'-O-methyl ribonucleotide
  modified_base (20)..(21): phosphorothioate linked nucleoside
agacccagcgguagggccuuu

SEQ ID NO: 3687 - DNA, 21 bp, Artificial Sequence
  Synthetic polynucleotide
  modified_base (1)..(21): Positions 2, 5-6, 8, 10, 12, 14, 16, 18, 20 2'-deoxy-2'-fluoro ("2'-fluoro") ribonucleotide
  modified_base (1)..(21): Positions 1, 3-4, 7, 9, 11, 13, 15, 17, 19, 21 2'-O-methyl ribonucleotide
  modified_base (20)..(21): phosphorothioate linked nucleoside
agacccagcgguagggccuuu

SEQ ID NO: 3688 - DNA, 21 bp, Artificial Sequence
  Synthetic polynucleotide
  modified_base (1)..(21): Positions 2-3, 6, 8, 10, 12, 14, 16, 18, 20 2'-deoxy-2'-fluoro ("2'-fluoro") ribonucleotide
  modified_base (1)..(21): Positions 1, 4-5, 7, 9, 11, 13, 15, 17, 19, 21 2'-O-methyl ribonucleotide
  modified_base (20)..(21): phosphorothioate linked nucleoside
agacccagcgguagggccuuu

SEQ ID NO: 3689 - DNA, 21 bp, Artificial Sequence
  Positions 3-4, 6, 8, 10, 12, 14, 16, 18, 20 2'-deoxy-2'-fluoro ("2'-fluoro") ribonucleotide
  modified_base (1)..(21): Positions 3-4, 6, 8, 10, 12, 14, 16, 18, 20 2'-deoxy-2'-fluoro ("2'-fluoro") ribonucleotide
  modified_base (1)..(21): Positions 1-2, 5, 7, 9, 11, 13, 15, 17, 19, 21 2'-O-methyl ribonucleotide
  modified_base (20)..(21): phosphorothioate linked nucleoside
agacccagcgguagggccuuu

SEQ ID NO: 3690 - DNA, 21 bp, Artificial Sequence
  Synthetic polynucleotide
  modified_base (1)..(21): Positions 1, 4, 6, 8, 10, 12, 14, 16, 18, 20 2'-deoxy-2'-fluoro ("2'-fluoro") ribonucleotide
  modified_base (1)..(21): Positions 2-3, 5, 7, 9, 11, 13, 15, 17, 19, 21 2'-O-methyl ribonucleotide
  modified_base (20)..(21): phosphorothioate linked nucleoside
agacccagcgguagggccuuu

SEQ ID NO: 3691 - DNA, 21 bp, Artificial Sequence
  Synthetic polynucleotide
  modified_base (1)..(21): Positions 1-2, 4, 6, 8, 10, 12, 14, 16, 18, 20 2'-deoxy-2'-fluoro ("2'-fluoro") ribonucleotide
  modified_base (1)..(21): Positions 3, 5, 7, 9, 11, 13, 15, 17, 19, 21 2'-O-methyl ribonucleotide
  modified_base (20)..(21): phosphorothioate linked nucleoside
agacccagcgguagggccuuu

SEQ ID NO: 3692 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
  modified_base (20)..(21): phosphorothioate linked nucleoside
agacccagcgguagggccuuu

SEQ ID NO: 3693 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
  modified_base (20)..(21): phosphorothioate linked nucleoside
agacccagcgguagggccuuu

SEQ ID NO: 3694 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
  modified_base (19)..(20): phosphorothioate linked nucleoside
agacccagcgguagggccuuu

SEQ ID NO: 3695 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
  modified_base (19)..(20): phosphorothioate linked nucleoside
agacccagcgguagggccuuu

SEQ ID NO: 3696 - DNA, 21 bp, Artificial Sequence
  Positions 5, 17 2'-O-methyl ribonucleotide
  modified_base (1)..(21): Positions 5, 17 2'-O-methyl ribonucleotide
  modified_base (21)..(21): phosphorothioate linked nucleoside
acuucaucuuucuucccactt

SEQ ID NO: 3697 - DNA, 21 bp, Artificial Sequence
  Synthetic polynucleotide
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (20)..(21): phosphorothioate linked nucleoside
acuucaucuuucuucccacuu

SEQ ID NO: 3698 - DNA, 21 bp, Artificial Sequence
  Synthetic polynucleotide
  modified_base (1)..(21): Positions 2, 4, 6, 8, 11, 14, 16, 18, 20 2'-deoxy-2'-fluoro ("2'-fluoro") ribonucleotide
  modified_base (1)..(21): Positions 1, 3, 5, 7, 9-10, 12-13, 15, 17, 19, 21 2'-O-methyl ribonucleotide
  modified_base (20)..(21): phosphorothioate linked nucleoside
acuucaucuuucuucccacuu

SEQ ID NO: 3699 - DNA, 21 bp, Artificial Sequence
  Synthetic polynucleotide
  modified_base (1)..(21): Positions 2, 4, 6, 8, 11-12, 14, 16, 18, 20 2'-deoxy-2'-fluoro ("2'-fluoro") ribonucleotide
  modified_base (1)..(21): Positions 1, 3, 5, 7, 9-10, 13, 15, 17, 19, 21 2'-O-methyl ribonucleotide
  modified_base (20)..(21): phosphorothioate linked nucleoside
acuucaucuuucuucccacuu

SEQ ID NO: 3700 - DNA, 21 bp, Artificial Sequence
  Synthetic polynucleotide
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (20)..(21): phosphorothioate linked nucleoside
acuucaucuuucuucccacuu

SEQ ID NO: 3701 - DNA, 21 bp, Artificial Sequence
  Synthetic polynucleotide
  modified_base (1)..(21): Positions 2, 4, 6, 9, 12, 14, 16, 18, 20 2'-deoxy-2'-fluoro ("2'-fluoro") ribonucleotide
  modified_base (1)..(21): Positions 1, 3, 5, 7-8, 10-11, 13, 15, 17, 19, 21 2'-O-methyl ribonucleotide
  modified_base (20)..(21): phosphorothioate linked nucleoside
acuucaucuuucuucccacuu

SEQ ID NO: 3702 - DNA, 21 bp, Artificial Sequence
  Positions 2, 4, 6, 8-9, 12, 14, 16, 18, 20 2'-deoxy-2'-fluoro ("2'-fluoro") ribonucleotide
  modified_base (1)..(21): Positions 2, 4, 6, 8-9, 12, 14, 16, 18, 20 2'-deoxy-2'-fluoro ("2'-fluoro") ribonucleotide
  modified_base (1)..(21): Positions 1, 3, 5, 7, 10-11, 13, 15, 17, 19, 21 2'-O-methyl ribonucleotide
  modified_base (20)..(21): phosphorothioate linked nucleoside
acuucaucuuucuucccacuu

SEQ ID NO: 3703 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (20)..(21): phosphorothioate linked nucleoside
acuucaucuuucuucccacuu

SEQ ID NO: 3704 - DNA, 21 bp, Artificial Sequence
  Synthetic polynucleotide
  modified_base (1)..(21): Positions 2, 4, 6-7, 10-12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (20)..(21): phosphorothioate linked nucleoside
acuucaucuuucuucccacuu

SEQ ID NO: 3705 - DNA, 21 bp, Artificial Sequence
  Synthetic polynucleotide
  modified_base (1)..(21): Positions 2-3, 20-21 phosphorothioate linked nucleoside
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
acuucaucuuucuucccacuu

SEQ ID NO: 3706 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
acuucaucuuucuucccacuu

SEQ ID NO: 3707 - DNA, 21 bp, Artificial Sequence
  Synthetic polynucleotide
  modified_base (1)..(21): Positions 2-3, 20-21 phosphorothioate linked nucleoside
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
acuucaucuuucuucccacuu

SEQ ID NO: 3708 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
acuucaucuuucuucccacuu

SEQ ID NO: 3709 - DNA, 21 bp, Artificial Sequence
  Synthetic polynucleotide
  modified_base (1)..(21): Positions 2, 4, 6, 8, 10, 12-13, 16, 18, 20 2'-deoxy-2'-fluoro ("2'-fluoro") ribonucleotide
  modified_base (1)..(21): Positions 1, 3, 5, 7, 9, 11, 14-15, 17, 19, 21 2'-O-methyl ribonucleotide
  modified_base (20)..(21): phosphorothioate linked nucleoside
acuucaucuuucuucccacuu

SEQ ID NO: 3710 - DNA, 21 bp, Artificial Sequence
  Synthetic polynucleotide
  modified_base (1)..(21): Positions 2, 4, 6, 8, 10, 12, 15-16, 18, 20 2'-deoxy-2'-fluoro ("2'-fluoro") ribonucleotide
  modified_base (1)..(21): Positions 1, 3, 5, 7, 9, 11, 13-14, 17, 19, 21 2'-O-methyl ribonucleotide
  modified_base (20)..(21): phosphorothioate linked nucleoside
acuucaucuuucuucccacuu

SEQ ID NO: 3711 - DNA, 21 bp, Artificial Sequence
  Synthetic polynucleotide
  modified_base (1)..(21): Positions 2, 4, 6, 8, 10, 12, 14-15, 18, 20 2'-deoxy-2'-fluoro ("2'-fluoro") ribonucleotide
  modified_base (1)..(21): Positions 1, 3, 5, 7, 9, 11, 13, 16-17, 19, 21 2'-O-methyl ribonucleotide
  modified_base (20)..(21): phosphorothioate linked nucleoside
acuucaucuuucuucccacuu

SEQ ID NO: 3712 - DNA, 21 bp, Artificial Sequence
  Synthetic polynucleotide
  modified_base (1)..(21): Positions 2, 4, 6, 8, 10, 12, 14, 17-18, 20 2'-deoxy-2'-fluoro ("2'-fluoro") ribonucleotide
  modified_base (1)..(21): Positions 1, 3, 5, 7, 9, 11, 13, 15-16, 19, 21 2'-O-methyl ribonucleotide
  modified_base (20)..(21): phosphorothioate linked nucleoside
acuucaucuuucuucccacuu

SEQ ID NO: 3713 - DNA, 21 bp, Artificial Sequence
  Synthetic polynucleotide
  modified_base (1)..(21): Positions 2, 4, 6, 8, 10, 12, 14, 16-17, 20 2'-deoxy-2'-fluoro ("2'-fluoro") ribonucleotide
  modified_base (1)..(21): Positions 1, 3, 5, 7, 9, 11, 13, 15, 18-19, 21 2'-O-methyl ribonucleotide
  modified_base (20)..(21): phosphorothioate linked nucleoside
acuucaucuuucuucccacuu

SEQ ID NO: 3714 - DNA, 21 bp, Artificial Sequence
  Synthetic polynucleotide
  modified_base (1)..(21): Positions 2, 4, 6, 8, 10, 12, 14, 16, 19-20 2'-deoxy-2'-fluoro ("2'-fluoro") ribonucleotide
  modified_base (1)..(21): Positions 1, 3, 5, 7, 9, 11, 13, 15, 17-18, 21 2'-O-methyl ribonucleotide
  modified_base (20)..(21): phosphorothioate linked nucleoside
acuucaucuuucuucccacuu

SEQ ID NO: 3715 - DNA, 21 bp, Artificial Sequence
  Synthetic polynucleotide
  modified_base (1)..(21): Positions 2, 4, 6, 8, 10, 12, 14, 16, 18-19 2'-deoxy-2'-fluoro ("2'-fluoro") ribonucleotide
  modified_base (1)..(21): Positions 1, 3, 5, 7, 9, 11, 13, 15, 17, 20-21 2'-O-methyl ribonucleotide
  modified_base (20)..(21): phosphorothioate linked nucleoside
acuucaucuuucuucccacuu

SEQ ID NO: 3716 - DNA, 21 bp, Artificial Sequence
  Synthetic polynucleotide
  modified_base (1)..(21): Positions 2, 4, 7-8, 10, 12, 14, 16, 18, 20 2'-deoxy-2'-fluoro ("2'-fluoro") ribonucleotide
  modified_base (1)..(21): Positions 1, 3, 5-6, 9, 11, 13, 15, 17, 19, 21 2'-O-methyl ribonucleotide
  modified_base (20)..(21): phosphorothioate linked nucleoside
acuucaucuuucuucccacuu

SEQ ID NO: 3717 - DNA, 21 bp, Artificial Sequence
  Synthetic polynucleotide
  modified_base (1)..(21): Positions 2, 4-5, 8, 10, 12, 14, 16, 18, 20 2'-deoxy-2'-fluoro ("2'-fluoro") ribonucleotide
  modified_base (1)..(21): Positions 1, 3, 6-7, 9, 11, 13, 15, 17, 19, 21 2'-O-methyl ribonucleotide
  modified_base (20)..(21): phosphorothioate linked nucleoside
acuucaucuuucuucccacuu

SEQ ID NO: 3718 - DNA, 21 bp, Artificial Sequence
  Synthetic polynucleotide
  modified_base (1)..(21): Positions 2, 5-6, 8, 10, 12, 14, 16, 18, 20 2'-deoxy-2'-fluoro ("2'-fluoro") ribonucleotide
  modified_base (1)..(21): Positions 1, 3-4, 7, 9, 11, 13, 15, 17, 19, 21 2'-O-methyl ribonucleotide
  modified_base (20)..(21): phosphorothioate linked nucleoside
acuucaucuuucuucccacuu

SEQ ID NO: 3719 - DNA, 21 bp, Artificial Sequence
  Synthetic polynucleotide
  modified_base (1)..(21): Positions 2-3, 6, 8, 10, 12, 14, 16, 18, 20 2'-deoxy-2'-fluoro ("2'-fluoro") ribonucleotide
  modified_base (1)..(21): Positions 1, 4-5, 7, 9, 11, 13, 15, 17, 19, 21 2'-O-methyl ribonucleotide
  modified_base (20)..(21): phosphorothioate linked nucleoside
acuucaucuuucuucccacuu

SEQ ID NO: 3720 - DNA, 21 bp, Artificial Sequence
  Synthetic polynucleotide
  modified_base (1)..(21): Positions 3-4, 6, 8, 10, 12, 14, 16, 18, 20 2'-deoxy-2'-fluoro ("2'-fluoro") ribonucleotide
  modified_base (1)..(21): Positions 1-2, 5, 7, 9, 11, 13, 15, 17, 19, 21 2'-O-methyl ribonucleotide
  modified_base (20)..(21): phosphorothioate linked nucleoside
acuucaucuuucuucccacuu

SEQ ID NO: 3721 - DNA, 21 bp, Artificial Sequence
  Synthetic polynucleotide
  modified_base (1)..(21): Positions 1, 4, 6, 8, 10, 12, 14, 16, 18, 20 2'-deoxy-2'-fluoro ("2'-fluoro") ribonucleotide
  modified_base (1)..(21): Positions 2-3, 5, 7, 9, 11, 13, 15, 17, 19, 21 2'-O-methyl ribonucleotide
  modified_base (20)..(21): phosphorothioate linked nucleoside
acuucaucuuucuucccacuu

SEQ ID NO: 3722 - DNA, 21 bp, Artificial Sequence
  Synthetic polynucleotide
  modified_base (1)..(21): Positions 1-2, 4, 6, 8, 10, 12, 14, 16, 18, 20 2'-deoxy-2'-fluoro ("2'-fluoro") ribonucleotide
  modified_base (1)..(21): Positions 3, 5, 7, 9, 11, 13, 15, 17, 19, 21 2'-O-methyl ribonucleotide
  modified_base (20)..(21): phosphorothioate linked nucleoside
acuucaucuuucuucccacuu

SEQ ID NO: 3723 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
  modified_base (20)..(21): phosphorothioate linked nucleoside
acuucaucuuucuucccacuu

SEQ ID NO: 3724 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
  modified_base (20)..(21): phosphorothioate linked nucleoside
acuucaucuuucuucccacuu

SEQ ID NO: 3725 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
  modified_base (20)..(21): phosphorothioate linked nucleoside
acuucaucuuucuucccacuu

SEQ ID NO: 3726 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
  modified_base (20)..(21): phosphorothioate linked nucleoside
acuucaucuuucuucccacuu

SEQ ID NO: 3727 - DNA, 21 bp, Artificial Sequence
  Synthetic polynucleotide
  modified_base (21)..(21): phosphorothioate linked nucleoside
aguucuugaagcccgucuctt

SEQ ID NO: 3728 - DNA, 21 bp, Artificial Sequence
  Synthetic polynucleotide
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (20)..(21): phosphorothioate linked nucleoside
aguucuugaagcccgucucuu

SEQ ID NO: 3729 - DNA, 21 bp, Artificial Sequence
  Synthetic polynucleotide
  modified_base (1)..(21): Positions 2, 4, 6, 8, 11, 14, 16, 18, 20 2'-deoxy-2'-fluoro ("2'-fluoro") ribonucleotide
  modified_base (1)..(21): Positions 1, 3, 5, 7, 9-10, 12-13, 15, 17, 19, 21 2'-O-methyl ribonucleotide
  modified_base (20)..(21): phosphorothioate linked nucleoside
aguucuugaagcccgucucuu

SEQ ID NO: 3730 - DNA, 21 bp, Artificial Sequence
  Synthetic polynucleotide
  modified_base (1)..(21): Positions 2, 4, 6, 8, 11-12, 14, 16, 18, 20 2'-deoxy-2'-fluoro ("2'-fluoro") ribonucleotide
  modified_base (1)..(21): Positions 1, 3, 5, 7, 9-10, 13, 15, 17, 19, 21 2'-O-methyl ribonucleotide
  modified_base (20)..(21): phosphorothioate linked nucleoside
aguucuugaagcccgucucuu

SEQ ID NO: 3731 - DNA, 21 bp, Artificial Sequence
  Synthetic polynucleotide
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (20)..(21): phosphorothioate linked nucleoside
aguucuugaagcccgucucuu

SEQ ID NO: 3732 - DNA, 21 bp, Artificial Sequence
  Synthetic polynucleotide
  modified_base (1)..(21): Positions 2, 4, 6, 9, 12, 14, 16, 18, 20 2'-deoxy-2'-fluoro ("2'-fluoro") ribonucleotide
  modified_base (1)..(21): Positions 1, 3, 5, 7-8, 10-11, 13, 15, 17, 19, 21 2'-O-methyl ribonucleotide
  modified_base (20)..(21): phosphorothioate linked nucleoside
aguucuugaagcccgucucuu

SEQ ID NO: 3733 - DNA, 21 bp, Artificial Sequence
  Synthetic polynucleotide
  modified_base (1)..(21): Positions 2, 4, 6, 8-9, 12, 14, 16, 18, 20 2'-deoxy-2'-fluoro ("2'-fluoro") ribonucleotide
  modified_base (1)..(21): Positions 1, 3, 5, 7, 10-11, 13, 15, 17, 19, 21 2'-O-methyl ribonucleotide
  modified_base (20)..(21): phosphorothioate linked nucleoside
aguucuugaagcccgucucuu

SEQ ID NO: 3734 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (20)..(21): phosphorothioate linked nucleoside
aguucuugaagcccgucucuu

SEQ ID NO: 3735 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (20)..(21): phosphorothioate linked nucleoside
aguucuugaagcccgucucuu

SEQ ID NO: 3736 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (1)..(21): Positions 2-3, 20-21 phosphorothioate linked nucleoside
aguucuugaagcccgucucuu

SEQ ID NO: 3737 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
aguucuugaagcccgucucuu

SEQ ID NO: 3738 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (1)..(21): Positions 2-3, 20-21 phosphorothioate linked nucleoside
aguucuugaagcccgucucuu

SEQ ID NO: 3739 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
aguucuugaagcccgucucuu

SEQ ID NO: 3740 - DNA, 21 bp, Artificial Sequence
  Synthetic polynucleotide
  modified_base (1)..(21): Positions 2, 4, 6, 8, 10, 12-13, 16, 18, 20 2'-deoxy-2'-fluoro ("2'-fluoro") ribonucleotide
  modified_base (1)..(21): Positions 1, 3, 5, 7, 9, 11, 14-15, 17, 19, 21 2'-O-methyl ribonucleotide
  modified_base (20)..(21): phosphorothioate linked nucleoside
aguucuugaagcccgucucuu

SEQ ID NO: 3741 - DNA, 21 bp, Artificial Sequence
  Synthetic polynucleotide
  modified_base (1)..(21): Positions 2, 4, 6, 8, 10, 12, 15-16, 18, 20 2'-deoxy-2'-fluoro ("2'-fluoro") ribonucleotide
  modified_base (1)..(21): Positions 1, 3, 5, 7, 9, 11, 13-14, 17, 19, 21 2'-O-methyl ribonucleotide
  modified_base (20)..(21): phosphorothioate linked nucleoside
aguucuugaagcccgucucuu

SEQ ID NO: 3742 - DNA, 21 bp, Artificial Sequence
  Synthetic polynucleotide
  modified_base (1)..(21): Positions 2, 4, 6, 8, 10, 12, 14-15, 18, 20 2'-deoxy-2'-fluoro ("2'-fluoro") ribonucleotide
  modified_base (1)..(21): Positions 1, 3, 5, 7, 9, 11, 13, 16-17, 19, 21 2'-O-methyl ribonucleotide
  modified_base (20)..(21): phosphorothioate linked nucleoside
aguucuugaagcccgucucuu

SEQ ID NO: 3743 - DNA, 21 bp, Artificial Sequence
  Synthetic polynucleotide
  modified_base (1)..(21): Positions 2, 4, 6, 8, 10, 12, 14, 17-18, 20 2'-deoxy-2'-fluoro ("2'-fluoro") ribonucleotide
  modified_base (1)..(21): Positions 1, 3, 5, 7, 9, 11, 13, 15-16, 19-21 2'-O-methyl ribonucleotide
  modified_base (20)..(21): phosphorothioate linked nucleoside
aguucuugaagcccgucucuu

SEQ ID NO: 3744 - DNA, 21 bp, Artificial Sequence
  Synthetic polynucleotide
  modified_base (1)..(21): Positions 2, 4, 6, 8, 10, 12, 14, 16-17, 20 2'-deoxy-2'-fluoro ("2'-fluoro") ribonucleotide
  modified_base (1)..(21): Positions 1, 3, 5, 7, 9, 11, 13, 15, 18-19, 21 2'-O-methyl ribonucleotide
  modified_base (20)..(21): phosphorothioate linked nucleoside
aguucuugaagcccgucucuu

SEQ ID NO: 3745 - DNA, 21 bp, Artificial Sequence
  Synthetic polynucleotide
  modified_base (1)..(21): Positions 2, 4, 6, 8, 10, 12, 14, 16, 19-20 2'-deoxy-2'-fluoro ("2'-fluoro") ribonucleotide
  modified_base (1)..(21): Positions 1, 3, 5, 7, 9, 11, 13, 15, 17-18, 21 2'-O-methyl ribonucleotide
  modified_base (20)..(21): phosphorothioate linked nucleoside
aguucuugaagcccgucucuu

SEQ ID NO: 3746 - DNA, 21 bp, Artificial Sequence
  Synthetic polynucleotide
  modified_base (1)..(21): Positions 2, 4, 6, 8, 10, 12, 14, 16, 18-19 2'-deoxy-2'-fluoro ("2'-fluoro") ribonucleotide
  modified_base (1)..(21): Positions 1, 3, 5, 7, 9, 11, 13, 15, 17, 20-21 2'-O-methyl ribonucleotide
  modified_base (20)..(21): phosphorothioate linked nucleoside
aguucuugaagcccgucucuu

SEQ ID NO: 3747 - DNA, 21 bp, Artificial Sequence
  Synthetic polynucleotide
  modified_base (1)..(21): Positions 2, 4, 7-8, 10, 12, 14, 16, 18, 20 2'-deoxy-2'-fluoro ("2'-fluoro") ribonucleotide
  modified_base (1)..(21): Positions 1, 3, 5-6, 9, 11, 13, 15, 17, 19, 21 2'-O-methyl ribonucleotide
  modified_base (20)..(21): phosphorothioate linked nucleoside
aguucuugaagcccgucucuu

SEQ ID NO: 3748 - DNA, 21 bp, Artificial Sequence
  Synthetic polynucleotide
  modified_base (1)..(21): Positions 2, 4-5, 8, 10, 12, 14, 16, 18, 20 2'-deoxy-2'-fluoro ("2'-fluoro") ribonucleotide
  modified_base (1)..(21): Positions 1, 3, 6-7, 9, 11, 13, 15, 17, 19, 21 2'-O-methyl ribonucleotide
  modified_base (20)..(21): phosphorothioate linked nucleoside
aguucuugaagcccgucucuu

SEQ ID NO: 3749 - DNA, 21 bp, Artificial Sequence
  Synthetic polynucleotide
  modified_base (1)..(21): Positions 2, 5-6, 8, 10, 12, 14, 16, 18, 20 2'-deoxy-2'-fluoro ("2'-fluoro") ribonucleotide
  modified_base (1)..(21): Positions 1, 3-4, 7, 9, 11, 13, 15, 17, 19, 21 2'-O-methyl ribonucleotide
  modified_base (20)..(21): phosphorothioate linked nucleoside
aguucuugaagcccgucucuu

SEQ ID NO: 3750 - DNA, 21 bp, Artificial Sequence
  Synthetic polynucleotide
  modified_base (1)..(21): Positions 2-3, 6, 8, 10, 12, 14, 16, 18, 20 2'-deoxy-2'-fluoro ("2'-fluoro") ribonucleotide
  modified_base (1)..(21): Positions 1, 4-5, 7, 9, 11, 13, 15, 17, 19, 21 2'-O-methyl ribonucleotide
  modified_base (20)..(21): phosphorothioate linked nucleoside
aguucuugaagcccgucucuu

SEQ ID NO: 3751 - DNA, 21 bp, Artificial Sequence
  Synthetic polynucleotide
  modified_base (1)..(21): Positions 3-4, 6, 8, 10, 12, 14, 16, 18, 20 2'-deoxy-2'-fluoro ("2'-fluoro") ribonucleotide
  modified_base (1)..(21): Positions 1-2, 5, 7, 9, 11, 13, 15, 17, 19, 21 2'-O-methyl ribonucleotide
  modified_base (20)..(21): phosphorothioate linked nucleoside
aguucuugaagcccgucucuu

SEQ ID NO: 3752 - DNA, 21 bp, Artificial Sequence
  Synthetic polynucleotide
  modified_base (1)..(21): Positions 1, 4, 6, 8, 10, 12, 14, 16, 18, 20 2'-deoxy-2'-fluoro ("2'-fluoro") ribonucleotide
  modified_base (1)..(21): Positions 2-3, 5, 7, 9, 11, 13, 15, 17, 19, 21 2'-O-methyl ribonucleotide
  modified_base (20)..(21): phosphorothioate linked nucleoside
aguucuugaagcccgucucuu

SEQ ID NO: 3753 - DNA, 21 bp, Artificial Sequence
  Synthetic polynucleotide
  modified_base (1)..(21): Positions 1-2, 4, 6, 8, 10, 12, 14, 16, 18, 20 2'-deoxy-2'-fluoro ("2'-fluoro") ribonucleotide
  modified_base (1)..(21): Positions 3, 5, 7, 9, 11, 13, 15, 17, 19, 21 2'-O-methyl ribonucleotide
  modified_base (20)..(21): phosphorothioate linked nucleoside
aguucuugaagcccgucucuu

SEQ ID NO: 3754 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
  modified_base (20)..(21): phosphorothioate linked nucleoside
aguucuugaagcccgucucuu

SEQ ID NO: 3755 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
  modified_base (20)..(21): phosphorothioate linked nucleoside
aguucuugaagcccgucucuu

SEQ ID NO: 3756 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
  modified_base (20)..(21): phosphorothioate linked nucleoside
aguucuugaagcccgucucuu

SEQ ID NO: 3757 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
  modified_base (20)..(21): phosphorothioate linked nucleoside
aguucuugaagcccgucucuu

SEQ ID NO: 3758 - DNA, 21 bp, Artificial Sequence
  Synthetic polynucleotide
  modified_base (1)..(21): Positions 3, 6, 9 2'-O-methyl ribonucleotide
  modified_base (21)..(21): phosphorothioate linked nucleoside
accaguagcagcugcgcuctt

SEQ ID NO: 3759 - DNA, 21 bp, Artificial Sequence
  Synthetic polynucleotide
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (20)..(21): phosphorothioate linked nucleoside
accaguagcagcugcgcucuu

SEQ ID NO: 3760 - DNA, 21 bp, Artificial Sequence
  Synthetic polynucleotide
  modified_base (1)..(21): Positions 2, 4, 6, 8, 11, 14, 16, 18, 20 2'-deoxy-2'-fluoro ("2'-fluoro") ribonucleotide
  modified_base (1)..(21): Positions 1, 3, 5, 7, 9-10, 12-13, 15, 17, 19, 21 2'-O-methyl ribonucleotide
  modified_base (20)..(21): phosphorothioate linked nucleoside
accaguagcagcugcgcucuu

SEQ ID NO: 3761 - DNA, 21 bp, Artificial Sequence
  Synthetic polynucleotide
  modified_base (1)..(21): Positions 2, 4, 6, 8, 11-12, 14, 16, 18, 20 2'-deoxy-2'-fluoro ("2'-fluoro") ribonucleotide
  modified_base (1)..(21): Positions 1, 3, 5, 7, 9-10, 13, 15, 17, 19, 21 2'-O-methyl ribonucleotide
  modified_base (20)..(21): phosphorothioate linked nucleoside
accaguagcagcugcgcucuu

SEQ ID NO: 3762 - DNA, 21 bp, Artificial Sequence
  Synthetic polynucleotide
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (20)..(21): phosphorothioate linked nucleoside
accaguagcagcugcgcucuu

SEQ ID NO: 3763 - DNA, 21 bp, Artificial Sequence
  Synthetic polynucleotide
  modified_base (1)..(21): Positions 2, 4, 6, 9, 12, 14, 16, 18, 20 2'-deoxy-2'-fluoro ("2'-fluoro") ribonucleotide
  modified_base (1)..(21): Positions 1, 3, 5, 7-8, 10-11, 13, 15, 17, 19, 21 2'-O-methyl ribonucleotide
  modified_base (20)..(21): phosphorothioate linked nucleoside
accaguagcagcugcgcucuu

SEQ ID NO: 3764 - DNA, 21 bp, Artificial Sequence
  Synthetic polynucleotide
  modified_base (1)..(21): Positions 2, 4, 6, 8-9, 12, 14, 16, 18, 20 2'-deoxy-2'-fluoro ("2'-fluoro") ribonucleotide
  modified_base (1)..(21): Positions 1, 3, 5, 7, 10-11, 13, 15, 17, 19, 21 2'-O-methyl ribonucleotide
  modified_base (20)..(21): phosphorothioate linked nucleoside
accaguagcagcugcgcucuu

SEQ ID NO: 3765 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (20)..(21): phosphorothioate linked nucleoside
accaguagcagcugcgcucuu

SEQ ID NO: 3766 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (20)..(21): phosphorothioate linked nucleoside
accaguagcagcugcgcucuu

SEQ ID NO: 3767 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (1)..(21): Position 2-3, 20-21 phosphorothioate linked nucleoside
accaguagcagcugcgcucuu

SEQ ID NO: 3768 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
accaguagcagcugcgcucuu

SEQ ID NO: 3769 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (1)..(21): Positions 2-3, 20-21 phosphorothioate linked nucleoside
accaguagcagcugcgcucuu

SEQ ID NO: 3770 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
accaguagcagcugcgcucuu

SEQ ID NO: 3771 - DNA, 21 bp, Artificial Sequence
  Synthetic polynucleotide
  modified_base (1)..(21): Positions 2, 4, 6, 8, 10, 12-13, 16, 18, 20 2'-deoxy-2'-fluoro ("2'-fluoro") ribonucleotide
  modified_base (1)..(21): Positions 1, 3, 5, 7, 9, 11, 14-15, 17, 19, 21 2'-O-methyl ribonucleotide
  modified_base (20)..(21): phosphorothioate linked nucleoside
accaguagcagcugcgcucuu

SEQ ID NO: 3772 - DNA, 21 bp, Artificial Sequence
  Synthetic polynucleotide
  modified_base (1)..(21): Positions 2, 4, 6, 8, 10, 12, 15-16, 18, 20 2'-deoxy-2'-fluoro ("2'-fluoro") ribonucleotide
  modified_base (1)..(21): Positions 1, 3, 5, 7, 9, 11, 13-14, 17, 19, 21 2'-O-methyl ribonucleotide
  modified_base (20)..(21): phosphorothioate linked nucleoside
accaguagcagcugcgcucuu

SEQ ID NO: 3773 - DNA, 21 bp, Artificial Sequence
  Synthetic polynucleotide
  modified_base (1)..(21): Positions 2, 4, 6, 8, 10, 12, 14-15, 18, 20 2'-deoxy-2'-fluoro ("2'-fluoro") ribonucleotide
  modified_base (1)..(21): Positions 1, 3, 5, 7, 9, 11, 13, 16-17, 19, 21 2'-O-methyl ribonucleotide
  modified_base (20)..(21): phosphorothioate linked nucleoside
accaguagcagcugcgcucuu

SEQ ID NO: 3774 - DNA, 21 bp, Artificial Sequence
  Synthetic polynucleotide
  modified_base (1)..(21): Positions 2, 4, 6, 8, 10, 12, 14, 17-18, 20 2'-deoxy-2'-fluoro ("2'-fluoro") ribonucleotide
  modified_base (1)..(21): Positions 1, 3, 5, 7, 9, 11, 13, 15-16, 19, 21 2'-O-methyl ribonucleotide
  modified_base (20)..(21): phosphorothioate linked nucleoside
accaguagcagcugcgcucuu

SEQ ID NO: 3775 - DNA, 21 bp, Artificial Sequence
  Synthetic polynucleotide
  modified_base (1)..(21): Positions 2, 4, 6, 8, 10, 12, 14, 16-17, 20 2'-deoxy-2'-fluoro ("2'-fluoro") ribonucleotide
  modified_base (1)..(21): Positions 1, 3, 5, 7, 9, 11, 13, 15, 18-19, 21 2'-O-methyl ribonucleotide
  modified_base (20)..(21): phosphorothioate linked nucleoside
accaguagcagcugcgcucuu

SEQ ID NO: 3776 - DNA, 21 bp, Artificial Sequence
  Synthetic polynucleotide
  modified_base (1)..(21): Positions 2, 4, 6, 8, 10, 12, 14, 16, 19-20 2'-deoxy-2'-fluoro ("2'-fluoro") ribonucleotide
  modified_base (1)..(21): Positions 1, 3, 5, 7, 9, 11, 13, 15, 17-18, 21 2'-O-methyl ribonucleotide
  modified_base (20)..(21): phosphorothioate linked nucleoside
accaguagcagcugcgcucuu

SEQ ID NO: 3777 - DNA, 21 bp, Artificial Sequence
  Synthetic polynucleotide
  modified_base (1)..(21): Positions 2, 4, 6, 8, 10, 12, 14, 16, 18-19 2'-deoxy-2'-fluoro ("2'-fluoro") ribonucleotide
  modified_base (1)..(21): Positions 1, 3, 5, 7, 9, 11, 13, 15, 17, 20-21 2'-O-methyl ribonucleotide
  modified_base (20)..(21): phosphorothioate linked nucleoside
accaguagcagcugcgcucuu

SEQ ID NO: 3778 - DNA, 21 bp, Artificial Sequence
  Synthetic polynucleotide
  modified_base (1)..(21): Positions 2, 4, 7-8, 10, 12, 14, 16, 18, 20 2'-deoxy-2'-fluoro ("2'-fluoro") ribonucleotide
  modified_base (1)..(21): Positions 1, 3, 5-6, 9, 11, 13, 15, 17, 19, 21 2'-O-methyl ribonucleotide
  modified_base (20)..(21): phosphorothioate linked nucleoside
accaguagcagcugcgcucuu

SEQ ID NO: 3779 - DNA, 21 bp, Artificial Sequence
  Synthetic polynucleotide
  modified_base (1)..(21): Positions 2, 4-5, 8, 10, 12, 14, 16, 18, 20 2'-deoxy-2'-fluoro ("2'-fluoro") ribonucleotide
  modified_base (1)..(21): Positions 1, 3, 6-7, 9, 11, 13, 15, 17, 19, 21 2'-O-methyl ribonucleotide
  modified_base (20)..(21): phosphorothioate linked nucleoside
accaguagcagcugcgcucuu

SEQ ID NO: 3780 - DNA, 21 bp, Artificial Sequence
  Synthetic polynucleotide
  modified_base (1)..(21): Positions 2, 5-6, 8, 10, 12, 14, 16, 18, 20 2'-deoxy-2'-fluoro ("2'-fluoro") ribonucleotide
  modified_base (1)..(21): Positions 1, 3-4, 7, 9, 11, 13, 15, 17, 19, 21 2'-O-methyl ribonucleotide
  modified_base (20)..(21): phosphorothioate linked nucleoside
accaguagcagcugcgcucuu

SEQ ID NO: 3781 - DNA, 21 bp, Artificial Sequence
  Synthetic polynucleotide
  modified_base (1)..(21): Positions 2-3, 6, 8, 10, 12, 14, 16, 18, 20 2'-deoxy-2'-fluoro ("2'-fluoro") ribonucleotide
  modified_base (1)..(21): Positions 1, 4-5, 7, 9, 11, 13, 15, 17, 19, 21 2'-O-methyl ribonucleotide
  modified_base (20)..(21): phosphorothioate linked nucleoside
accaguagcagcugcgcucuu

SEQ ID NO: 3782 - DNA, 21 bp, Artificial Sequence
  Synthetic polynucleotide
  modified_base (1)..(21): Positions 3-4, 6, 8, 10, 12, 14, 16, 18, 20 2'-deoxy-2'-fluoro ("2'-fluoro") ribonucleotide
  modified_base (1)..(21): Positions 1-2, 5, 7, 9, 11, 13, 15, 17, 19, 21 2'-O-methyl ribonucleotide
  modified_base (20)..(21): phosphorothioate linked nucleoside
accaguagcagcugcgcucuu

SEQ ID NO: 3783 - DNA, 21 bp, Artificial Sequence
  Synthetic polynucleotide
  modified_base (1)..(21): Positions 1, 4, 6, 8, 10, 12, 14, 16, 18, 20 2'-deoxy-2'-fluoro ("2'-fluoro") ribonucleotide
  modified_base (1)..(21): Positions 2-3, 5, 7, 9, 11, 13, 15, 17, 19, 21 2'-O-methyl ribonucleotide
  modified_base (20)..(21): phosphorothioate linked nucleoside
accaguagcagcugcgcucuu

SEQ ID NO: 3784 - DNA, 21 bp, Artificial Sequence
  Synthetic polynucleotide
  modified_base (1)..(21): Positions 1-2, 4, 6, 8, 10, 12, 14, 16, 18, 20 2'-deoxy-2'-fluoro ("2'-fluoro") ribonucleotide
  modified_base (1)..(21): Positions 3, 5, 7, 9, 11, 13, 15, 17, 19, 21 2'-O-methyl ribonucleotide
  modified_base (20)..(21): phosphorothioate linked nucleoside
accaguagcagcugcgcucuu

SEQ ID NO: 3785 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions2-3, 6-7, 10-11, 14-15, 18-19 2'-O-methyl ribonucleotide
  modified_base (20)..(21): phosphorothioate linked nucleoside
accaguagcagcugcgcucuu

SEQ ID NO: 3786 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
  modified_base (20)..(21): phosphorothioate linked nucleoside
accaguagcagcugcgcucuu

SEQ ID NO: 3787 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
  modified_base (20)..(21): phosphorothioate linked nucleoside
accaguagcagcugcgcucuu

SEQ ID NO: 3788 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
  modified_base (20)..(21): phosphorothioate linked nucleoside
accaguagcagcugcgcucuu

SEQ ID NO: 3789 - DNA, 21 bp, Artificial Sequence
  Synthetic polynucleotide
  modified_base (1)..(21): Positions 8, 10, 12, 16 2'-O-methyl ribonucleotide
  modified_base (21)..(21): phosphorothioate linked nucleoside
auccgaucacacagacaactt

SEQ ID NO: 3790 - DNA, 21 bp, Artificial Sequence
  Synthetic polynucleotide
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (20)..(21): phosphorothioate linked nucleoside
auccgaucacacagacaacuu

SEQ ID NO: 3791 - DNA, 21 bp, Artificial Sequence
  Synthetic polynucleotide
  modified_base (1)..(21): Positions 2, 4, 6, 8, 11, 14, 16, 18, 20 2'-deoxy-2'-fluoro ("2'-fluoro") ribonucleotide
  modified_base (1)..(21): Positions 1, 3, 5, 7, 9-10, 12-13, 15, 17, 19, 21 2'-O-methyl ribonucleotide
  modified_base (20)..(21): phosphorothioate linked nucleoside
auccgaucacacagacaacuu

SEQ ID NO: 3792 - DNA, 21 bp, Artificial Sequence
  Synthetic polynucleotide
  modified_base (1)..(21): Positions 2, 4, 6, 8, 11-12, 14, 16, 18, 20 2'-deoxy-2'-fluoro ("2'-fluoro") ribonucleotide
  modified_base (1)..(21): Positions 1, 3, 5, 7, 9-10, 13, 15, 17, 19, 21 2'-O-methyl ribonucleotide
  modified_base (20)..(21): phosphorothioate linked nucleoside
auccgaucacacagacaacuu

SEQ ID NO: 3793 - DNA, 21 bp, Artificial Sequence
  Synthetic polynucleotide
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (20)..(21): phosphorothioate linked nucleoside
auccgaucacacagacaacuu

SEQ ID NO: 3794 - DNA, 21 bp, Artificial Sequence
  Synthetic polynucleotide
  modified_base (1)..(21): Positions 2, 4, 6, 9, 12, 14, 16, 18, 20 2'-deoxy-2'-fluoro ("2'-fluoro") ribonucleotide
  modified_base (1)..(21): Positions 1, 3, 5, 7-8, 10-11, 13, 15, 17, 19, 21 2'-O-methyl ribonucleotide
  modified_base (20)..(21): phosphorothioate linked nucleoside
auccgaucacacagacaacuu

SEQ ID NO: 3795 - DNA, 21 bp, Artificial Sequence
  Synthetic polynucleotide
  modified_base (1)..(21): Positions 2, 4, 6, 8-9, 12, 14, 16, 18, 20 2'-deoxy-2'-fluoro ("2'-fluoro") ribonucleotide
  modified_base (1)..(21): Positions 1, 3, 5, 7, 10-11, 13, 15, 17, 19, 21 2'-O-methyl ribonucleotide
  modified_base (20)..(21): phosphorothioate linked nucleoside
auccgaucacacagacaacuu

SEQ ID NO: 3796 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (20)..(21): phosphorothioate linked nucleoside
auccgaucacacagacaacuu

SEQ ID NO: 3797 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (20)..(21): phosphorothioate linked nucleoside
auccgaucacacagacaacuu

SEQ ID NO: 3798 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (1)..(21): Positions 2-3, 20-21 phosphorothioate linked nucleoside
auccgaucacacagacaacuu

SEQ ID NO: 3799 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
auccgaucacacagacaacuu

SEQ ID NO: 3800 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (1)..(21): Positions 2-3, 20-21 phosphorothioate linked nucleoside
auccgaucacacagacaacuu

SEQ ID NO: 3801 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
auccgaucacacagacaacuu

SEQ ID NO: 3802 - DNA, 21 bp, Artificial Sequence
  Synthetic polynucleotide
  modified_base (1)..(21): Positions 2, 4, 6, 8, 10, 12-13, 16, 18, 20 2'-deoxy-2'-fluoro ("2'-fluoro") ribonucleotide
  modified_base (1)..(21): Positions 1, 3, 5, 7, 9, 11, 14-15, 17, 19, 21 2'-O-methyl ribonucleotide
  modified_base (20)..(21): phosphorothioate linked nucleoside
auccgaucacacagacaacuu

SEQ ID NO: 3803 - DNA, 21 bp, Artificial Sequence
  Synthetic polynucleotide
  modified_base (1)..(21): Positions 2, 4, 6, 8, 10, 12, 15-16, 18, 20 2'-deoxy-2'-fluoro ("2'-fluoro") ribonucleotide
  modified_base (1)..(21): Positions 1, 3, 5, 7, 9, 11, 13-14, 17, 19, 21 2'-O-methyl ribonucleotide
  modified_base (20)..(21): phosphorothioate linked nucleoside
auccgaucacacagacaacuu

SEQ ID NO: 3804 - DNA, 21 bp, Artificial Sequence
  Synthetic polynucleotide
  modified_base (1)..(21): Positions 2, 4, 6, 8, 10, 12, 14-15, 18, 20 2'-deoxy-2'-fluoro ("2'-fluoro") ribonucleotide
  modified_base (1)..(21): Positions 1, 3, 5, 7, 9, 11, 13, 16-17, 19, 21 2'-O-methyl ribonucleotide
  modified_base (20)..(21): phosphorothioate linked nucleoside
auccgaucacacagacaacuu

SEQ ID NO: 3805 - DNA, 21 bp, Artificial Sequence
  Synthetic polynucleotide
  modified_base (1)..(21): Positions 2, 4, 6, 8, 10, 12, 14, 17-18, 20 2'-deoxy-2'-fluoro ("2'-fluoro") ribonucleotide
  modified_base (1)..(21): Positions 1, 3, 5, 7, 9, 11, 13, 15-16, 19, 21 2'-O-methyl ribonucleotide
  modified_base (20)..(21): phosphorothioate linked nucleoside
auccgaucacacagacaacuu

SEQ ID NO: 3806 - DNA, 21 bp, Artificial Sequence
  Synthetic polynucleotide
  modified_base (1)..(21): Positions 2, 4, 6, 8, 10, 12, 14, 16-17, 20 2'-deoxy-2'-fluoro ("2'-fluoro") ribonucleotide
  modified_base (1)..(21): Positions 1, 3, 5, 7, 9, 11, 13, 15, 18-19, 21 2'-O-methyl ribonucleotide
  modified_base (20)..(21): phosphorothioate linked nucleoside
auccgaucacacagacaacuu

SEQ ID NO: 3807 - DNA, 21 bp, Artificial Sequence
  Synthetic polynucleotide
  modified_base (1)..(21): Positions 2, 4, 6, 8, 10, 12, 14, 16, 19-20 2'-deoxy-2'-fluoro ("2'-fluoro") ribonucleotide
  modified_base (1)..(21): Positions 1, 3, 5, 7, 9, 11, 13, 15, 17-18, 21 2'-O-methyl ribonucleotide
  modified_base (20)..(21): phosphorothioate linked nucleoside
auccgaucacacagacaacuu

SEQ ID NO: 3808 - DNA, 21 bp, Artificial Sequence
  Synthetic polynucleotide
  modified_base (1)..(21): Positions 2, 4, 6, 8, 10, 12, 14, 16, 18-19 2'-deoxy-2'-fluoro ("2'-fluoro") ribonucleotide
  modified_base (1)..(21): Positions 1, 3, 5, 7, 9, 11, 13, 15, 17, 20-21 2'-O-methyl ribonucleotide
  modified_base (20)..(21): phosphorothioate linked nucleoside
auccgaucacacagacaacuu

SEQ ID NO: 3809 - DNA, 21 bp, Artificial Sequence
  Synthetic polynucleotide
  modified_base (1)..(21): Positions 2, 4, 7-8, 10, 12, 14, 16, 18, 20 2'-deoxy-2'-fluoro ("2'-fluoro") ribonucleotide
  modified_base (1)..(21): Positions 1, 3, 5-6, 9, 11, 13, 15, 17, 19, 21 2'-O-methyl ribonucleotide
  modified_base (20)..(21): phosphorothioate linked nucleoside
auccgaucacacagacaacuu

SEQ ID NO: 3810 - DNA, 21 bp, Artificial Sequence
  Synthetic polynucleotide
  modified_base (1)..(21): Positions 2, 4-5, 8, 10, 12, 14, 16, 18, 20 2'-deoxy-2'-fluoro ("2'-fluoro") ribonucleotide
  modified_base (1)..(21): Positions 1, 3, 6-7, 9, 11, 13, 15, 17, 19, 21 2'-O-methyl ribonucleotide
  modified_base (20)..(21): phosphorothioate linked nucleoside
auccgaucacacagacaacuu

SEQ ID NO: 3811 - DNA, 21 bp, Artificial Sequence
  Synthetic polynucleotide
  modified_base (1)..(21): Positions 2, 5-6, 8, 10, 12, 14, 16, 18, 20 2'-deoxy-2'-fluoro ("2'-fluoro") ribonucleotide
  modified_base (1)..(21): Positions 1, 3-4, 7, 9, 11, 13, 15, 17, 19, 21 2'-O-methyl ribonucleotide
  modified_base (20)..(21): phosphorothioate linked nucleoside
auccgaucacacagacaacuu

SEQ ID NO: 3812 - DNA, 21 bp, Artificial Sequence
  Synthetic polynucleotide
  modified_base (1)..(21): Positions 2-3, 6, 8, 10, 12, 14, 16, 18, 20 2'-deoxy-2'-fluoro ("2'-fluoro") ribonucleotide
  modified_base (1)..(21): Positions 1, 4-5, 7, 9, 11, 13, 15, 17, 19, 21 2'-O-methyl ribonucleotide
  modified_base (20)..(21): phosphorothioate linked nucleoside
auccgaucacacagacaacuu

SEQ ID NO: 3813 - DNA, 21 bp, Artificial Sequence
  Synthetic polynucleotide
  modified_base (1)..(21): Positions 3-4, 6, 8, 10, 12, 14, 16, 18, 20 2'-deoxy-2'-fluoro ("2'-fluoro") ribonucleotide
  modified_base (1)..(21): Positions 1-2, 5, 7, 9, 11, 13, 15, 17, 19, 21 2'-O-methyl ribonucleotide
  modified_base (20)..(21): phosphorothioate linked nucleoside
auccgaucacacagacaacuu

SEQ ID NO: 3814 - DNA, 21 bp, Artificial Sequence
  Synthetic polynucleotide
  modified_base (1)..(21): Positions 1, 4, 6, 8, 10, 12, 14, 16, 18, 20 2'-deoxy-2'-fluoro ("2'-fluoro") ribonucleotide
  modified_base (1)..(21): Positions 2-3, 5, 7, 9, 11, 13, 15, 17, 19, 21 2'-O-methyl ribonucleotide
  modified_base (20)..(21): phosphorothioate linked nucleoside
auccgaucacacagacaacuu

SEQ ID NO: 3815 - DNA, 21 bp, Artificial Sequence
  Synthetic polynucleotide
  modified_base (1)..(21): Positions 1-2, 4, 6, 8, 10, 12, 14, 16, 18, 20 2'-deoxy-2'-fluoro ("2'-fluoro") ribonucleotide
  modified_base (1)..(21): Positions 3, 5, 7, 9, 11, 13, 15, 17, 19, 21 2'-O-methyl ribonucleotide
  modified_base (20)..(21): phosphorothioate linked nucleoside
auccgaucacacagacaacuu

SEQ ID NO: 3816 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 23, 6-7, 10-11, 14-15, 18-19 2'-O-methyl ribonucleotide
  modified_base (20)..(21): phosphorothioate linked nucleoside
auccgaucacacagacaacuu

SEQ ID NO: 3817 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
  modified_base (20)..(21): phosphorothioate linked nucleoside
auccgaucacacagacaacuu

SEQ ID NO: 3818 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
  modified_base (20)..(21): phosphorothioate linked nucleoside
auccgaucacacagacaacuu

SEQ ID NO: 3819 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
  modified_base (20)..(21): phosphorothioate linked nucleoside
auccgaucacacagacaacuu

SEQ ID NO: 3820 - DNA, 21 bp, Artificial Sequence
  Synthetic polynucleotide
  modified_base (1)..(21): Positions 4, 13 2'-O-methyl ribonucleotide
  modified_base (21)..(21): phosphorothioate linked nucleoside
ucucaggccccgcagcucctt

SEQ ID NO: 3821 - DNA, 21 bp, Artificial Sequence
  Synthetic polynucleotide
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (20)..(21): phosphorothioate linked nucleoside
ucucaggccccgcagcuccuu

SEQ ID NO: 3822 - DNA, 21 bp, Artificial Sequence
  Synthetic polynucleotide
  modified_base (1)..(21): Positions 2, 4, 6, 8, 11, 14, 16, 18, 20 2'-deoxy-2'-fluoro ("2'-fluoro") ribonucleotide
  modified_base (1)..(21): Positions 1, 3, 5, 7, 9-10, 12-13, 15, 17, 19, 21 2'-O-methyl ribonucleotide
  modified_base (20)..(21): phosphorothioate linked nucleoside
ucucaggccccgcagcuccuu

SEQ ID NO: 3823 - DNA, 21 bp, Artificial Sequence
  Synthetic polynucleotide
  modified_base (1)..(21): Positions 2, 4, 6, 8, 11-12, 14, 16, 18, 20 2'-deoxy-2'-fluoro ("2'-fluoro") ribonucleotide
  modified_base (1)..(21): Positions1, 3, 5, 7, 9-10, 13, 15, 17, 19, 21 2'-O-methyl ribonucleotide
  modified_base (20)..(21): phosphorothioate linked nucleoside
ucucaggccccgcagcuccuu

SEQ ID NO: 3824 - DNA, 21 bp, Artificial Sequence
  Synthetic polynucleotide
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (20)..(21): phosphorothioate linked nucleoside
ucucaggccccgcagcuccuu

SEQ ID NO: 3825 - DNA, 21 bp, Artificial Sequence
  Synthetic polynucleotide
  modified_base (1)..(21): Positions 2, 4, 6, 9, 12, 14, 16, 18, 20 2'-deoxy-2'-fluoro ("2'-fluoro") ribonucleotide
  modified_base (1)..(21): Positions 1, 3, 5, 7-8, 10-11, 13, 15, 17, 19, 21 2'-O-methyl ribonucleotide
  modified_base (20)..(21): phosphorothioate linked nucleoside
ucucaggccccgcagcuccuu

SEQ ID NO: 3826 - DNA, 21 bp, Artificial Sequence
  Synthetic polynucleotide
  modified_base (1)..(21): Positions 2, 4, 6, 8-9, 12, 14, 16, 18, 20 2'-deoxy-2'-fluoro ("2'-fluoro") ribonucleotide
  modified_base (1)..(21): Positions 1, 3, 5, 7, 10-11, 13, 15, 17, 19, 21 2'-O-methyl ribonucleotide
  modified_base (20)..(21): phosphorothioate linked nucleoside
ucucaggccccgcagcuccuu

SEQ ID NO: 3827 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (20)..(21): phosphorothioate linked nucleoside
ucucaggccccgcagcuccuu

SEQ ID NO: 3828 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (20)..(21): phosphorothioate linked nucleoside
ucucaggccccgcagcuccuu

SEQ ID NO: 3829 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (1)..(21): Positions 2-3, 20-21 phosphorothioate linked nucleoside
ucucaggccccgcagcuccuu

SEQ ID NO: 3830 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
ucucaggccccgcagcuccuu

SEQ ID NO: 3831 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (1)..(21): Positions 2-3, 20-21 phosphorothioate linked nucleoside
ucucaggccccgcagcuccuu

SEQ ID NO: 3832 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
ucucaggccccgcagcuccuu

SEQ ID NO: 3833 - DNA, 21 bp, Artificial Sequence
  Synthetic polynucleotide
  modified_base (1)..(21): Positions 2, 4, 6, 8, 10, 12-13, 16, 18, 20 2'-deoxy-2'-fluoro ("2'-fluoro") ribonucleotide
  modified_base (1)..(21): Positions 1, 3, 5, 7, 9, 11, 14-15, 17, 19, 21 2'-O-methyl ribonucleotide
  modified_base (20)..(21): phosphorothioate linked nucleoside
ucucaggccccgcagcuccuu

SEQ ID NO: 3834 - DNA, 21 bp, Artificial Sequence
  Synthetic polynucleotide
  modified_base (1)..(21): Positions 2, 4, 6, 8, 10, 12, 15-16, 18, 20 2'-deoxy-2'-fluoro ("2'-fluoro") ribonucleotide
  modified_base (1)..(21): Positions 1, 3, 5, 7, 9, 11, 13-14, 17, 19, 21 2'-O-methyl ribonucleotide
  modified_base (20)..(21): phosphorothioate linked nucleoside
ucucaggccccgcagcuccuu

SEQ ID NO: 3835 - DNA, 21 bp, Artificial Sequence
  Synthetic polynucleotide
  modified_base (1)..(21): Positions 2, 4, 6, 8, 10, 12, 14-15, 18, 20 2'-deoxy-2'-fluoro ("2'-fluoro") ribonucleotide
  modified_base (1)..(21): Positions 1, 3, 5, 7, 9, 11, 13, 16-17, 19, 21 2'-O-methyl ribonucleotide
  modified_base (20)..(21): phosphorothioate linked nucleoside
ucucaggccccgcagcuccuu

SEQ ID NO: 3836 - DNA, 21 bp, Artificial Sequence
  Synthetic polynucleotide
  modified_base (1)..(21): Positions 2, 4, 6, 8, 10, 12, 14, 17-18, 20 2'-deoxy-2'-fluoro ("2'-fluoro") ribonucleotide
  modified_base (1)..(21): Positions 1, 3, 5, 7, 9, 11, 13, 15-16, 19, 21 2'-O-methyl ribonucleotide
  modified_base (20)..(21): phosphorothioate linked nucleoside
ucucaggccccgcagcuccuu

SEQ ID NO: 3837 - DNA, 21 bp, Artificial Sequence
  Synthetic polynucleotide
  modified_base (1)..(21): Positions 2, 4, 6, 8, 10, 12, 14, 16-17, 20 2'-deoxy-2'-fluoro ("2'-fluoro") ribonucleotide
  modified_base (1)..(21): Positions 1, 3, 5, 7, 9, 11, 13, 15, 18-19, 21 2'-O-methyl ribonucleotide
  modified_base (20)..(21): phosphorothioate linked nucleoside
ucucaggccccgcagcuccuu

SEQ ID NO: 3838 - DNA, 21 bp, Artificial Sequence
  Synthetic polynucleotide
  modified_base (1)..(21): Positions 2, 4, 6, 8, 10, 12, 14, 16, 19-20 2'-deoxy-2'-fluoro ("2'-fluoro") ribonucleotide
  modified_base (1)..(21): Positions 1, 3, 5, 7, 9, 11, 13, 15, 17-18, 21 2'-O-methyl ribonucleotide
  modified_base (20)..(21): phosphorothioate linked nucleoside
ucucaggccccgcagcuccuu

SEQ ID NO: 3839 - DNA, 21 bp, Artificial Sequence
  Synthetic polynucleotide
  modified_base (1)..(21): Positions 2, 4, 6, 8, 10, 12, 14, 16, 18-19 2'-deoxy-2'-fluoro ("2'-fluoro") ribonucleotide
  modified_base (1)..(21): Positions 1, 3, 5, 7, 9, 11, 13, 15, 17, 20-21 2'-O-methyl ribonucleotide
  modified_base (20)..(21): phosphorothioate linked nucleoside
ucucaggccccgcagcuccuu

SEQ ID NO: 3840 - DNA, 21 bp, Artificial Sequence
  Synthetic polynucleotide
  modified_base (1)..(21): Positions 2, 4, 7-8, 10, 12, 14, 16, 18, 20 2'-deoxy-2'-fluoro ("2'-fluoro") ribonucleotide
  modified_base (1)..(21): Positions 1, 3, 5-6, 9, 11, 13, 15, 17, 19, 21 2'-O-methyl ribonucleotide
  modified_base (20)..(21): phosphorothioate linked nucleoside
ucucaggccccgcagcuccuu

SEQ ID NO: 3841 - DNA, 21 bp, Artificial Sequence
  Synthetic polynucleotide
  modified_base (1)..(21): Positions 2, 4-5, 8, 1-, 12, 14, 16, 18, 20 2'-deoxy-2'-fluoro ("2'-fluoro") ribonucleotide
  modified_base (1)..(21): Positions 1, 3, 6-7, 9, 11, 13, 15, 17, 19, 21 2'-O-methyl ribonucleotide
  modified_base (20)..(21): phosphorothioate linked nucleoside
ucucaggccccgcagcuccuu

SEQ ID NO: 3842 - DNA, 21 bp, Artificial Sequence
  Synthetic polynucleotide
  modified_base (1)..(21): Positions 2, 5-6, 8, 10, 12, 14, 16, 18, 20 2'-deoxy-2'-fluoro ("2'-fluoro") ribonucleotide
  modified_base (1)..(21): Positions1, 3-4, 7, 9, 11, 13, 15, 17, 19, 21 2'-O-methyl ribonucleotide
  modified_base (20)..(21): phosphorothioate linked nucleoside
ucucaggccccgcagcuccuu

SEQ ID NO: 3843 - DNA, 21 bp, Artificial Sequence
  Synthetic polynucleotide
  modified_base (1)..(21): Positions 2-3, 6, 8, 10, 12, 14, 16, 18, 20 2'-deoxy-2'-fluoro ("2'-fluoro") ribonucleotide
  modified_base (1)..(21): Positions 1, 4-5, 7, 9, 11, 13, 15, 17, 19, 21 2'-O-methyl ribonucleotide
  modified_base (20)..(21): phosphorothioate linked nucleoside
ucucaggccccgcagcuccuu

SEQ ID NO: 3844 - DNA, 21 bp, Artificial Sequence
  Synthetic polynucleotide
  modified_base (1)..(21): Positions 3-4, 6, 8, 10, 12, 14, 16, 18, 20 2'-deoxy-2'-fluoro ("2'-fluoro") ribonucleotide
  modified_base (1)..(21): Positions 1-2, 5, 7, 9, 11, 13, 15, 17, 19, 21 2'-O-methyl ribonucleotide
  modified_base (20)..(21): phosphorothioate linked nucleoside
ucucaggccccgcagcuccuu

SEQ ID NO: 3845 - DNA, 21 bp, Artificial Sequence
  Synthetic polynucleotide
  modified_base (1)..(21): Positions 1, 4, 6, 8, 10, 12, 14, 16, 18, 20 2'-deoxy-2'-fluoro ("2'-fluoro") ribonucleotide
  modified_base (1)..(21): Positions 2-3, 5, 7, 9, 11, 13, 15, 17, 19, 21 2'-O-methyl ribonucleotide
  modified_base (20)..(21): phosphorothioate linked nucleoside
ucucaggccccgcagcuccuu

SEQ ID NO: 3846 - DNA, 21 bp, Artificial Sequence
  Synthetic polynucleotide
  modified_base (1)..(21): Positions 1-2, 4, 6, 8, 10, 12, 14, 16, 18, 20 2'-deoxy-2'-fluoro ("2'-fluoro") ribonucleotide
  modified_base (1)..(21): Positions 3, 5, 7, 9, 11, 13, 15, 17, 19, 21 2'-O-methyl ribonucleotide
  modified_base (20)..(21): phosphorothioate linked nucleoside
ucucaggccccgcagcuccuu

SEQ ID NO: 3847 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
  modified_base (20)..(21): phosphorothioate linked nucleoside
ucucaggccccgcagcuccuu

SEQ ID NO: 3848 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
  modified_base (20)..(21): phosphorothioate linked nucleoside
ucucaggccccgcagcuccuu

SEQ ID NO: 3849 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
  modified_base (20)..(21): phosphorothioate linked nucleoside
ucucaggccccgcagcuccuu

SEQ ID NO: 3850 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
  modified_base (20)..(21): phosphorothioate linked nucleoside
ucucaggccccgcagcuccuu

SEQ ID NO: 3851 - DNA, 21 bp, Artificial Sequence
  Synthetic polynucleotide
  modified_base (13)..(13): 2'-O-methyl ribonucleotide
  modified_base (21)..(21): phosphorothioate linked nucleoside
acgucgucguuccagcggctt

SEQ ID NO: 3852 - DNA, 21 bp, Artificial Sequence
  Synthetic polynucleotide
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (20)..(21): phosphorothioate linked nucleoside
acgucgucguuccagcggcuu

SEQ ID NO: 3853 - DNA, 21 bp, Artificial Sequence
  Synthetic polynucleotide
  modified_base (1)..(21): Positions 2, 4, 6, 8, 11, 14, 16, 18, 20 2'-deoxy-2'-fluoro ("2'-fluoro") ribonucleotide
  modified_base (1)..(21): Positions 1, 3, 5, 7, 9-10, 12-13, 15, 17, 19, 21 2'-O-methyl ribonucleotide
  modified_base (20)..(21): phosphorothioate linked nucleoside
acgucgucguuccagcggcuu

SEQ ID NO: 3854 - DNA, 21 bp, Artificial Sequence
  Synthetic polynucleotide
  modified_base (1)..(21): Positions 2, 4, 6, 8, 11-12, 14, 16, 18, 20 2'-deoxy-2'-fluoro ("2'-fluoro") ribonucleotide
  modified_base (1)..(21): Positions 1, 3, 5, 7, 9-10, 13, 15, 17, 19, 21 2'-O-methyl ribonucleotide
  modified_base (20)..(21): phosphorothioate linked nucleoside
acgucgucguuccagcggcuu

SEQ ID NO: 3855 - DNA, 21 bp, Artificial Sequence
  Synthetic polynucleotide
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (20)..(21): phosphorothioate linked nucleoside
acgucgucguuccagcggcuu

SEQ ID NO: 3856 - DNA, 21 bp, Artificial Sequence
  Synthetic polynucleotide
  modified_base (1)..(21): Positions 2, 4, 6, 9, 12, 14, 16, 18, 20 2'-deoxy-2'-fluoro ("2'-fluoro") ribonucleotide
  modified_base (1)..(21): Positions 1, 3, 5, 7-8, 10-11, 13, 15, 17, 19, 21 2'-O-methyl ribonucleotide
  modified_base (20)..(21): phosphorothioate linked nucleoside
acgucgucguuccagcggcuu

SEQ ID NO: 3857 - DNA, 21 bp, Artificial Sequence
  Synthetic polynucleotide
  modified_base (1)..(21): Positions 2, 4, 6, 8-9, 12, 14, 16, 18, 20 2'-deoxy-2'-fluoro ("2'-fluoro") ribonucleotide
  modified_base (1)..(21): Positions 1, 3, 5, 7, 10-11, 13, 15, 17, 19, 21 2'-O-methyl ribonucleotide
  modified_base (20)..(21): phosphorothioate linked nucleoside
acgucgucguuccagcggcuu

SEQ ID NO: 3858 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (20)..(21): phosphorothioate linked nucleoside
acgucgucguuccagcggcuu

SEQ ID NO: 3859 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (20)..(21): phosphorothioate linked nucleoside
acgucgucguuccagcggcuu

SEQ ID NO: 3860 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (1)..(21): Positions 2-3, 20-21 phosphorothioate linked nucleoside
acgucgucguuccagcggcuu

SEQ ID NO: 3861 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
acgucgucguuccagcggcuu

SEQ ID NO: 3862 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (1)..(21): Positions 2-3, 20-21 phosphorothioate linked nucleoside
acgucgucguuccagcggcuu

SEQ ID NO: 3863 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
acgucgucguuccagcggcuu

SEQ ID NO: 3864 - DNA, 21 bp, Artificial Sequence
  Synthetic polynucleotide
  modified_base (1)..(21): Positions 2, 4, 6, 8, 10, 12-13, 16, 18, 20 2'-deoxy-2'-fluoro ("2'-fluoro") ribonucleotide
  modified_base (1)..(21): Positions 1, 3, 5, 7, 9, 11, 14-15, 17, 19, 21 2'-O-methyl ribonucleotide
  modified_base (20)..(21): phosphorothioate linked nucleoside
acgucgucguuccagcggcuu

SEQ ID NO: 3865 - DNA, 21 bp, Artificial Sequence
  Synthetic polynucleotide
  modified_base (1)..(21): Positions 2, 4, 6, 8, 10, 12, 15-16, 18, 20 2'-deoxy-2'-fluoro ("2'-fluoro") ribonucleotide
  modified_base (1)..(21): Positions 1, 3, 5, 7, 9, 11, 13-14, 17, 19, 21 2'-O-methyl ribonucleotide
  modified_base (20)..(21): phosphorothioate linked nucleoside
acgucgucguuccagcggcuu

SEQ ID NO: 3866 - DNA, 21 bp, Artificial Sequence
  Synthetic polynucleotide
  modified_base (1)..(21): Positions 2, 4, 6, 8, 10, 12, 14-15, 18, 20 2'-deoxy-2'-fluoro ("2'-fluoro") ribonucleotide
  modified_base (1)..(21): Positions 1, 3, 5, 7, 9, 11, 13, 16-17, 19, 21 2'-O-methyl ribonucleotide
  modified_base (20)..(21): phosphorothioate linked nucleoside
acgucgucguuccagcggcuu

SEQ ID NO: 3867 - DNA, 21 bp, Artificial Sequence
  Synthetic polynucleotide
  modified_base (1)..(21): Positions 2, 4, 6, 8, 10, 12, 14, 17-18, 20 2'-deoxy-2'-fluoro ("2'-fluoro") ribonucleotide
  modified_base (1)..(21): Positions 1, 3, 5, 7, 9, 11, 13, 15-16, 19, 21 2'-O-methyl ribonucleotide
  modified_base (20)..(21): phosphorothioate linked nucleoside
acgucgucguuccagcggcuu

SEQ ID NO: 3868 - DNA, 21 bp, Artificial Sequence
  Synthetic polynucleotide
  modified_base (1)..(21): Positions 2, 4, 6, 8, 10, 12, 14, 16-17, 20 2'-deoxy-2'-fluoro ("2'-fluoro") ribonucleotide
  modified_base (1)..(21): Positions 1, 3, 5, 7, 9, 11, 13, 15, 18-19, 21 2'-O-methyl ribonucleotide
  modified_base (20)..(21): phosphorothioate linked nucleoside
acgucgucguuccagcggcuu

SEQ ID NO: 3869 - DNA, 21 bp, Artificial Sequence
  Synthetic polynucleotide
  modified_base (1)..(21): Positions 2, 4, 6, 8, 10, 12, 14, 16, 19-20 2'-deoxy-2'-fluoro ("2'-fluoro") ribonucleotide
  modified_base (1)..(21): Positions 1, 3, 5, 7, 9, 11, 13, 15, 17-18, 21, 2'-O-methyl ribonucleotide
  modified_base (20)..(21): phosphorothioate linked nucleoside
acgucgucguuccagcggcuu

SEQ ID NO: 3870 - DNA, 21 bp, Artificial Sequence
  Synthetic polynucleotide
  modified_base (1)..(21): Positions 2, 4, 6, 8, 10, 12, 14, 16, 18-19 2'-deoxy-2'-fluoro ("2'-fluoro") ribonucleotide
  modified_base (1)..(21): Positions 1, 3, 5, 7, 9, 11, 13, 15, 17, 20-21 2'-O-methyl ribonucleotide
  modified_base (20)..(21): phosphorothioate linked nucleoside
acgucgucguuccagcggcuu

SEQ ID NO: 3871 - DNA, 21 bp, Artificial Sequence
  Synthetic polynucleotide
  modified_base (1)..(21): Positions 2, 4, 7-8, 10, 12, 14, 16, 18, 20 2'-deoxy-2'-fluoro ("2'-fluoro") ribonucleotide
  modified_base (1)..(21): Positions 1, 3, 5-6, 9, 11, 13, 15, 17, 19, 21 2'-O-methyl ribonucleotide
  modified_base (20)..(21): phosphorothioate linked nucleoside
acgucgucguuccagcggcuu

SEQ ID NO: 3872 - DNA, 21 bp, Artificial Sequence
  Synthetic polynucleotide
  modified_base (1)..(21): Positions 2, 4-5, 8, 10, 12, 14, 16, 18, 20 2'-deoxy-2'-fluoro ("2'-fluoro") ribonucleotide
  modified_base (1)..(21): Positions 1, 3, 6-7, 9, 11, 13, 15, 17, 19, 21 2'-O-methyl ribonucleotide
  modified_base (20)..(21): phosphorothioate linked nucleoside
acgucgucguuccagcggcuu

SEQ ID NO: 3873 - DNA, 21 bp, Artificial Sequence
  Synthetic polynucleotide
  modified_base (1)..(21): Positions 2, 5-6, 8, 10, 12, 14, 16, 18, 20 2'-deoxy-2'-fluoro ("2'-fluoro") ribonucleotide
  modified_base (1)..(21): Positions 1, 3-4, 7, 9, 11, 13, 15, 17, 19, 21 2'-O-methyl ribonucleotide
  modified_base (20)..(21): phosphorothioate linked nucleoside
acgucgucguuccagcggcuu

SEQ ID NO: 3874 - DNA, 21 bp, Artificial Sequence
  Synthetic polynucleotide
  modified_base (1)..(21): Positions 2-3, 6, 8, 10, 12, 14, 16, 18, 20 2'-deoxy-2'-fluoro ("2'-fluoro") ribonucleotide
  modified_base (1)..(21): Positions 1, 4-5, 7, 9, 11, 13, 15, 17, 19, 21 2'-O-methyl ribonucleotide
  modified_base (20)..(21): phosphorothioate linked nucleoside
acgucgucguuccagcggcuu

SEQ ID NO: 3875 - DNA, 21 bp, Artificial Sequence
  Synthetic polynucleotide
  modified_base (1)..(21): Positions 3-4, 6, 8, 10, 12, 14, 16, 18, 20 2'-deoxy-2'-fluoro ("2'-fluoro") ribonucleotide
  modified_base (1)..(21): Positions 1-2, 5, 7, 9, 11, 13, 15, 17, 19, 21 2'-O-methyl ribonucleotide
  modified_base (20)..(21): phosphorothioate linked nucleoside
acgucgucguuccagcggcuu

SEQ ID NO: 3876 - DNA, 21 bp, Artificial Sequence
  Synthetic polynucleotide
  modified_base (1)..(21): Positions 1, 4, 6, 8, 10, 12, 14, 16, 18, 20 2'-deoxy-2'-fluoro ("2'-fluoro") ribonucleotide
  modified_base (1)..(21): Positions 2-3, 5, 7, 9, 11, 13, 15, 17, 19, 21 2'-O-methyl ribonucleotide
  modified_base (20)..(21): phosphorothioate linked nucleoside
acgucgucguuccagcggcuu

SEQ ID NO: 3877 - DNA, 21 bp, Artificial Sequence
  Synthetic polynucleotide
  modified_base (1)..(21): Positions 1-2, 4, 6, 8, 10, 12, 14, 16, 18, 20 2'-deoxy-2'-fluoro ("2'-fluoro") ribonucleotide
  modified_base (1)..(21): Positions 3, 5, 7, 9, 11, 13, 15, 17, 19, 21 2'-O-methyl ribonucleotide
  modified_base (20)..(21): phosphorothioate linked nucleoside
acgucgucguuccagcggcuu

SEQ ID NO: 3878 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
  modified_base (20)..(21): phosphorothioate linked nucleoside
acgucgucguuccagcggcuu

SEQ ID NO: 3879 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
  modified_base (20)..(21): phosphorothioate linked nucleoside
acgucgucguuccagcggcuu

SEQ ID NO: 3880 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 4-5, 7-8, 11-12, 15-16, 19-20 2'-O-methyl ribonucleotide
  modified_base (20)..(21): phosphorothioate linked nucleoside
acgucgucguuccagcggcuu

SEQ ID NO: 3881 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
  modified_base (20)..(21): phosphorothioate linked nucleoside
acgucgucguuccagcggcuu

SEQ ID NO: 3882 - DNA, 21 bp, Artificial Sequence
  Synthetic polynucleotide
  modified_base (1)..(21): Positions 7, 10, 13 2'-O-methyl ribonucleotide
  modified_base (21)..(21): phosphorothioate linked nucleoside
gagaaccaguagcagcugctt

SEQ ID NO: 3883 - DNA, 21 bp, Artificial Sequence
  Synthetic polynucleotide
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (20)..(21): phosphorothioate linked nucleoside
gagaaccaguagcagcugcuu

SEQ ID NO: 3884 - DNA, 21 bp, Artificial Sequence
  Synthetic polynucleotide
  modified_base (1)..(21): Positions 2, 4, 6, 8, 11, 14, 16, 18, 20 2'-deoxy-2'-fluoro ("2'-fluoro") ribonucleotide
  modified_base (1)..(21): Positions 1, 3, 5, 7, 9-10, 12-13, 15, 17, 19, 21 2'-O-methyl ribonucleotide
  modified_base (20)..(21): phosphorothioate linked nucleoside
gagaaccaguagcagcugcuu

SEQ ID NO: 3885 - DNA, 21 bp, Artificial Sequence
  Synthetic polynucleotide
  modified_base (1)..(21): Positions 2, 4, 6, 8, 11-12, 14, 16, 18, 20 2'-deoxy-2'-fluoro ("2'-fluoro") ribonucleotide
  modified_base (1)..(21): Positions 1, 3, 5, 7, 9-10, 13, 15, 17, 19, 21 2'-O-methyl ribonucleotide
  modified_base (20)..(21): phosphorothioate linked nucleoside
gagaaccaguagcagcugcuu

SEQ ID NO: 3886 - DNA, 21 bp, Artificial Sequence
  Synthetic polynucleotide
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (20)..(21): phosphorothioate linked nucleoside
gagaaccaguagcagcugcuu

SEQ ID NO: 3887 - DNA, 21 bp, Artificial Sequence
  Synthetic polynucleotide
  modified_base (1)..(21): Positions 2, 4, 6, 9, 12, 14, 16, 18, 20 2'-deoxy-2'-fluoro ("2'-fluoro") ribonucleotide
  modified_base (1)..(21): Positions 1, 3, 5, 7-8, 10-11, 13, 15, 17, 19, 21 2'-O-methyl ribonucleotide
  modified_base (20)..(21): phosphorothioate linked nucleoside
gagaaccaguagcagcugcuu

SEQ ID NO: 3888 - DNA, 21 bp, Artificial Sequence
  Synthetic polynucleotide
  modified_base (1)..(21): Positions 2, 4, 6, 8-9, 12, 14, 16, 18, 20 2'-deoxy-2'-fluoro ("2'-fluoro") ribonucleotide
  modified_base (1)..(21): Positions 1, 3, 5, 7, 10-11, 13, 15, 17, 19, 21 2'-O-methyl ribonucleotide
  modified_base (20)..(21): phosphorothioate linked nucleoside
gagaaccaguagcagcugcuu

SEQ ID NO: 3889 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (20)..(21): phosphorothioate linked nucleoside
gagaaccaguagcagcugcuu

SEQ ID NO: 3890 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (20)..(21): phosphorothioate linked nucleoside
gagaaccaguagcagcugcuu

SEQ ID NO: 3891 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (1)..(21): Positions 2-3, 20-21 phosphorothioate linked nucleoside
gagaaccaguagcagcugcuu

SEQ ID NO: 3892 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
gagaaccaguagcagcugcuu

SEQ ID NO: 3893 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (1)..(21): Positions 2-3, 20-21 phosphorothioate linked nucleoside
gagaaccaguagcagcugcuu

SEQ ID NO: 3894 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
gagaaccaguagcagcugcuu

SEQ ID NO: 3895 - DNA, 21 bp, Artificial Sequence
  Synthetic polynucleotide
  modified_base (1)..(21): Positions 2, 4, 6, 8, 10, 12-13, 16, 18, 20 2'-deoxy-2'-fluoro ("2'-fluoro") ribonucleotide
  modified_base (1)..(21): Positions 1, 3, 5, 7, 9, 11, 14-15, 17, 19, 21 2'-O-methyl ribonucleotide
  modified_base (20)..(21): phosphorothioate linked nucleoside
gagaaccaguagcagcugcuu

SEQ ID NO: 3896 - DNA, 21 bp, Artificial Sequence
  Synthetic polynucleotide
  modified_base (1)..(21): Positions 2, 4, 6, 8, 10, 12, 15-16, 18, 20 2'-deoxy-2'-fluoro ("2'-fluoro") ribonucleotide
  modified_base (1)..(21): Positions 1, 3, 5, 7, 9, 11, 13-14, 17, 19, 21 2'-O-methyl ribonucleotide
  modified_base (20)..(21): phosphorothioate linked nucleoside
gagaaccaguagcagcugcuu

SEQ ID NO: 3897 - DNA, 21 bp, Artificial Sequence
  Synthetic polynucleotide
  modified_base (1)..(21): Positions 2, 4, 6, 8, 10, 12, 14-15, 18, 20 2'-deoxy-2'-fluoro ("2'-fluoro") ribonucleotide
  modified_base (1)..(21): Positions 1, 3, 5, 7, 9, 11, 13, 16-17, 19, 21 2'-O-methyl ribonucleotide
  modified_base (20)..(21): phosphorothioate linked nucleoside
gagaaccaguagcagcugcuu

SEQ ID NO: 3898 - DNA, 21 bp, Artificial Sequence
  Synthetic polynucleotide
  modified_base (1)..(21): Positions 2, 4, 6, 8, 10, 12, 14, 17-18, 20 2'-deoxy-2'-fluoro ("2'-fluoro") ribonucleotide
  modified_base (1)..(21): Positions 1, 3, 5, 7, 9, 11, 13, 15-16, 19, 21 2'-O-methyl ribonucleotide
  modified_base (20)..(21): phosphorothioate linked nucleoside
gagaaccaguagcagcugcuu

SEQ ID NO: 3899 - DNA, 21 bp, Artificial Sequence
  Synthetic polynucleotide
  modified_base (1)..(21): Positions 2, 4, 6, 8, 10, 12, 14, 16-17, 20 2'-deoxy-2'-fluoro ("2'-fluoro") ribonucleotide
  modified_base (1)..(21): Positions 1, 3, 5, 7, 9, 11, 13, 15, 18-19, 21 2'-O-methyl ribonucleotide
  modified_base (20)..(21): phosphorothioate linked nucleoside
gagaaccaguagcagcugcuu

SEQ ID NO: 3900 - DNA, 21 bp, Artificial Sequence
  Synthetic polynucleotide
  modified_base (1)..(21): Positions 2, 4, 6, 8, 10, 12, 14, 16, 19-20 2'-deoxy-2'-fluoro ("2'-fluoro") ribonucleotide
  modified_base (1)..(21): Positions 1, 3, 5, 7, 9, 11, 13, 15, 17-18, 21 2'-O-methyl ribonucleotide
  modified_base (20)..(21): phosphorothioate linked nucleoside
gagaaccaguagcagcugcuu

SEQ ID NO: 3901 - DNA, 21 bp, Artificial Sequence
  Synthetic polynucleotide
  modified_base (1)..(21): Positions 2, 4, 6, 8, 10, 12, 14, 16, 18-19 2'-deoxy-2'-fluoro ("2'-fluoro") ribonucleotide
  modified_base (1)..(21): Positions 1, 3, 5, 7, 9, 11, 13, 15, 17, 20-21 2'-O-methyl ribonucleotide
  modified_base (20)..(21): phosphorothioate linked nucleoside
gagaaccaguagcagcugcuu

SEQ ID NO: 3902 - DNA, 21 bp, Artificial Sequence
  Synthetic polynucleotide
  modified_base (1)..(21): Positions 2, 4, 7-8, 10, 12, 14, 16, 18, 20 2'-deoxy-2'-fluoro ("2'-fluoro") ribonucleotide
  modified_base (1)..(21): Positions 1, 3, 5-6, 9, 11, 13, 15, 17, 19, 21 2'-O-methyl ribonucleotide
  modified_base (20)..(21): phosphorothioate linked nucleoside
gagaaccaguagcagcugcuu

SEQ ID NO: 3903 - DNA, 21 bp, Artificial Sequence
  Synthetic polynucleotide
  modified_base (1)..(21): Positions 2, 4-5, 8, 10, 12, 14, 16, 18, 20 2'-deoxy-2'-fluoro ("2'-fluoro") ribonucleotide
  modified_base (1)..(21): Positions 1, 3, 6-7, 9, 11, 13, 15, 17, 19, 21 2'-O-methyl ribonucleotide
  modified_base (20)..(21): phosphorothioate linked nucleoside
gagaaccaguagcagcugcuu

SEQ ID NO: 3904 - DNA, 21 bp, Artificial Sequence
  Synthetic polynucleotide
  modified_base (1)..(21): Positions 2, 5-6, 8, 10, 12, 14, 16, 18, 20 2'-deoxy-2'-fluoro ("2'-fluoro") ribonucleotide
  modified_base (1)..(21): Positions 1, 3-4, 7, 9, 11, 13, 15, 17, 19, 21 2'-O-methyl ribonucleotide
  modified_base (20)..(21): phosphorothioate linked nucleoside
gagaaccaguagcagcugcuu

SEQ ID NO: 3905 - DNA, 21 bp, Artificial Sequence
  Synthetic polynucleotide
  modified_base (1)..(21): Positions 2-3, 6, 8, 10, 12, 14, 16, 18, 20 2'-deoxy-2'-fluoro ("2'-fluoro") ribonucleotide
  modified_base (1)..(21): Positions 1, 4-5, 7, 9, 11, 13, 15, 17, 19, 21 2'-O-methyl ribonucleotide
  modified_base (20)..(21): phosphorothioate linked nucleoside
gagaaccaguagcagcugcuu

SEQ ID NO: 3906 - DNA, 21 bp, Artificial Sequence
  Synthetic polynucleotide
  modified_base (1)..(21): Positions 3-4, 6, 8, 10, 12, 14, 16, 18, 20 2'-deoxy-2'-fluoro ("2'-fluoro") ribonucleotide
  modified_base (1)..(21): Positions 1-2, 5, 7, 9, 11, 13, 15, 17, 19, 21 2'-O-methyl ribonucleotide
  modified_base (20)..(21): phosphorothioate linked nucleoside
gagaaccaguagcagcugcuu

SEQ ID NO: 3907 - DNA, 21 bp, Artificial Sequence
  Synthetic polynucleotide
  modified_base (1)..(21): Positions 1, 4, 6, 8, 10, 12, 14, 16, 18, 20 2'-deoxy-2'-fluoro ("2'-fluoro") ribonucleotide
  modified_base (1)..(21): Positions 2-3, 5, 7, 9, 11, 13, 15, 17, 19, 21 2'-O-methyl ribonucleotide
  modified_base (20)..(21): phosphorothioate linked nucleoside
gagaaccaguagcagcugcuu

SEQ ID NO: 3908 - DNA, 21 bp, Artificial Sequence
  Synthetic polynucleotide
  modified_base (1)..(21): Positions 1-2, 4, 6, 8, 10, 12, 14, 16, 18, 20 2'-deoxy-2'-fluoro ("2'-fluoro") ribonucleotide
  modified_base (1)..(21): Positions 3, 5, 7, 9, 11, 13, 15, 17, 19, 21 2'-O-methyl ribonucleotide
  modified_base (20)..(21): phosphorothioate linked nucleoside
gagaaccaguagcagcugcuu

SEQ ID NO: 3909 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
  modified_base (20)..(21): phosphorothioate linked nucleoside
gagaaccaguagcagcugcuu

SEQ ID NO: 3910 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
  modified_base (20)..(21): phosphorothioate linked nucleoside
gagaaccaguagcagcugcuu

SEQ ID NO: 3911 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
  modified_base (20)..(21): phosphorothioate linked nucleoside
gagaaccaguagcagcugcuu

SEQ ID NO: 3912 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
  modified_base (20)..(21): phosphorothioate linked nucleoside
gagaaccaguagcagcugcuu

SEQ ID NO: 3913 - DNA, 21 bp, Artificial Sequence
  Synthetic polynucleotide
  modified_base (1)..(21): Positions 10, 16 2'-O-methyl ribonucleotide
  modified_base (21)..(21): phosphorothioate linked nucleoside
ucugucucgcagacccagctt

SEQ ID NO: 3914 - DNA, 21 bp, Artificial Sequence
  Synthetic polynucleotide
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (20)..(21): phosphorothioate linked nucleoside
ucugucucgcagacccagcuu

SEQ ID NO: 3915 - DNA, 21 bp, Artificial Sequence
  Synthetic polynucleotide
  modified_base (1)..(21): Positions 2, 4, 6, 8, 11, 14, 16, 18, 20 2'-deoxy-2'-fluoro ("2'-fluoro") ribonucleotide
  modified_base (1)..(21): Positions 1, 3, 5, 7, 9-10, 12-13, 15, 17, 19, 21 2'-O-methyl ribonucleotide
  modified_base (20)..(21): phosphorothioate linked nucleoside
ucugucucgcagacccagcuu

SEQ ID NO: 3916 - DNA, 21 bp, Artificial Sequence
  Synthetic polynucleotide
  modified_base (1)..(21): Positions 2, 4, 6, 8, 11-12, 14, 16, 18, 20 2'-deoxy-2'-fluoro ("2'-fluoro") ribonucleotide
  modified_base (1)..(21): Positions 1, 3, 5, 7, 9-10, 13, 15, 17, 19, 21 2'-O-methyl ribonucleotide
  modified_base (20)..(21): phosphorothioate linked nucleoside
ucugucucgcagacccagcuu

SEQ ID NO: 3917 - DNA, 21 bp, Artificial Sequence
  Synthetic polynucleotide
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (20)..(21): phosphorothioate linked nucleoside
ucugucucgcagacccagcuu

SEQ ID NO: 3918 - DNA, 21 bp, Artificial Sequence
  Synthetic polynucleotide
  modified_base (1)..(21): Positions 2, 4, 6, 9, 12, 14, 16, 18, 20 2'-deoxy-2'-fluoro ("2'-fluoro") ribonucleotide
  modified_base (1)..(21): Positions 1, 3, 5, 7-8, 10-11, 13, 15, 17, 19, 21 2'-O-methyl ribonucleotide
  modified_base (20)..(21): phosphorothioate linked nucleoside
ucugucucgcagacccagcuu

SEQ ID NO: 3919 - DNA, 21 bp, Artificial Sequence
  Synthetic polynucleotide
  modified_base (1)..(21): Positions 2, 4, 6, 8-9, 12, 14, 16, 18, 20 2'-deoxy-2'-fluoro ("2'-fluoro") ribonucleotide
  modified_base (1)..(21): Positions 1, 3, 5, 7, 10-11, 13, 15, 17, 19, 21 2'-O-methyl ribonucleotide
  modified_base (20)..(21): phosphorothioate linked nucleoside
ucugucucgcagacccagcuu

SEQ ID NO: 3920 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (20)..(21): phosphorothioate linked nucleoside
ucugucucgcagacccagcuu

SEQ ID NO: 3921 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (20)..(21): phosphorothioate linked nucleoside
ucugucucgcagacccagcuu

SEQ ID NO: 3922 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (1)..(21): Positions 2-3, 20-21 phosphorothioate linked nucleoside
ucugucucgcagacccagcuu

SEQ ID NO: 3923 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
ucugucucgcagacccagcuu

SEQ ID NO: 3924 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (1)..(21): Positions 2-3, 20-21 phosphorothioate linked nucleoside
ucugucucgcagacccagcuu

SEQ ID NO: 3925 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
ucugucucgcagacccagcuu

SEQ ID NO: 3926 - DNA, 21 bp, Artificial Sequence
  Synthetic polynucleotide
  modified_base (1)..(21): Positions 2, 4, 6, 8, 10, 12-13, 16, 18, 20 2'-deoxy-2'-fluoro ("2'-fluoro") ribonucleotide
  modified_base (1)..(21): Positions 1, 3, 5, 7, 9, 11, 14-15, 17, 19, 21 2'-O-methyl ribonucleotide
  modified_base (20)..(21): phosphorothioate linked nucleoside
ucugucucgcagacccagcuu

SEQ ID NO: 3927 - DNA, 21 bp, Artificial Sequence
  Synthetic polynucleotide
  modified_base (1)..(21): Positions 2, 4, 6, 8, 10, 12, 15-16, 18, 20 2'-deoxy-2'-fluoro ("2'-fluoro") ribonucleotide
  modified_base (1)..(21): Positions 1, 3, 5, 7, 9, 11, 13-14, 17, 19, 21 2'-O-methyl ribonucleotide
  modified_base (20)..(21): phosphorothioate linked nucleoside
ucugucucgcagacccagcuu

SEQ ID NO: 3928 - DNA, 21 bp, Artificial Sequence
  Synthetic polynucleotide
  modified_base (1)..(21): Positions 2, 4, 6, 8, 10, 12, 14-15, 18, 20 2'-deoxy-2'-fluoro ("2'-fluoro") ribonucleotide
  modified_base (1)..(21): Positions 1, 3, 5, 7, 9, 11, 13, 16-17, 19, 21 2'-O-methyl ribonucleotide
  modified_base (20)..(21): phosphorothioate linked nucleoside
ucugucucgcagacccagcuu

SEQ ID NO: 3929 - DNA, 21 bp, Artificial Sequence
  Synthetic polynucleotide
  modified_base (1)..(21): Positions 2, 4, 6, 8, 10, 12, 14, 17-18, 20 2'-deoxy-2'-fluoro ("2'-fluoro") ribonucleotide
  modified_base (1)..(21): Positions 1, 3, 5, 7, 9, 11, 13, 15-16, 19, 21 2'-O-methyl ribonucleotide
  modified_base (20)..(21): phosphorothioate linked nucleoside
ucugucucgcagacccagcuu

SEQ ID NO: 3930 - DNA, 21 bp, Artificial Sequence
  Synthetic polynucleotide
  modified_base (1)..(21): Positions 2, 4, 6, 8, 10, 12, 14, 16-17, 20 2'-deoxy-2'-fluoro ("2'-fluoro") ribonucleotide
  modified_base (1)..(21): Positions 1, 3, 5, 7, 9, 11, 13, 15, 18-19, 21 2'-O-methyl ribonucleotide
  modified_base (20)..(21): phosphorothioate linked nucleoside
ucugucucgcagacccagcuu

SEQ ID NO: 3931 - DNA, 21 bp, Artificial Sequence
  Synthetic polynucleotide
  modified_base (1)..(21): Positions 2, 4, 6, 8, 10, 12, 14, 16, 19-20 2'-deoxy-2'-fluoro ("2'-fluoro") ribonucleotide
  modified_base (1)..(21): Positions 1, 3, 5, 7, 9, 11, 13, 15, 17-18, 21 2'-O-methyl ribonucleotide
  modified_base (20)..(21): phosphorothioate linked nucleoside
ucugucucgcagacccagcuu

SEQ ID NO: 3932 - DNA, 21 bp, Artificial Sequence
  Synthetic polynucleotide
  modified_base (1)..(21): Positions 2, 4, 6, 8, 10, 12, 14, 16, 18-19 2'-deoxy-2'-fluoro ("2'-fluoro") ribonucleotide
  modified_base (1)..(21): Positions 1, 3, 5, 7, 9, 11, 13, 15, 17, 20-21 2'-O-methyl ribonucleotide
  modified_base (20)..(21): phosphorothioate linked nucleoside
ucugucucgcagacccagcuu

SEQ ID NO: 3933 - DNA, 21 bp, Artificial Sequence
  Synthetic polynucleotide
  modified_base (1)..(21): Positions 2, 4, 7-8, 10, 12, 14, 16, 18, 20 2'-deoxy-2'-fluoro ("2'-fluoro") ribonucleotide
  modified_base (1)..(21): Positions 1, 3, 5-6, 9, 11, 13, 15, 17, 19, 21 2'-O-methyl ribonucleotide
  modified_base (20)..(21): phosphorothioate linked nucleoside
ucugucucgcagacccagcuu

SEQ ID NO: 3934 - DNA, 21 bp, Artificial Sequence
  Synthetic polynucleotide
  modified_base (1)..(21): Positions 2, 4-5, 8, 10, 12, 14, 16, 18, 20 2'-deoxy-2'-fluoro ("2'-fluoro") ribonucleotide
  modified_base (1)..(21): Positions 1, 3, 6-7, 9, 11, 13, 15, 17, 19, 21 2'-O-methyl ribonucleotide
  modified_base (20)..(21): phosphorothioate linked nucleoside
ucugucucgcagacccagcuu

SEQ ID NO: 3935 - DNA, 21 bp, Artificial Sequence
  Synthetic polynucleotide
  modified_base (1)..(21): Positions 2, 5-6, 8, 10, 12, 14, 16, 18, 20 2'-deoxy-2'-fluoro ("2'-fluoro") ribonucleotide
  modified_base (1)..(21): Positions 1, 3-4, 7, 9, 11, 13, 15, 17, 19, 21 2'-O-methyl ribonucleotide
  modified_base (20)..(21): phosphorothioate linked nucleoside
ucugucucgcagacccagcuu

SEQ ID NO: 3936 - DNA, 21 bp, Artificial Sequence
  Synthetic polynucleotide
  modified_base (1)..(21): Positions 2-3, 6, 8, 10, 12, 14, 16, 18, 20 2'-deoxy-2'-fluoro ("2'-fluoro") ribonucleotide
  modified_base (1)..(21): Positions 1, 4-5, 7, 9, 11, 13, 15, 17, 19, 21 2'-O-methyl ribonucleotide
  modified_base (20)..(21): phosphorothioate linked nucleoside
ucugucucgcagacccagcuu

SEQ ID NO: 3937 - DNA, 21 bp, Artificial Sequence
  Synthetic polynucleotide
  modified_base (1)..(21): Positions 3-4, 6, 8, 10, 12, 14, 16, 18, 20 2'-deoxy-2'-fluoro ("2'-fluoro") ribonucleotide
  modified_base (1)..(21): Positions 1-2, 5, 7, 9, 11, 13, 15, 17, 19, 21 2'-O-methyl ribonucleotide
  modified_base (20)..(21): phosphorothioate linked nucleoside
ucugucucgcagacccagcuu

SEQ ID NO: 3938 - DNA, 21 bp, Artificial Sequence
  Synthetic polynucleotide
  modified_base (1)..(21): Positions 1, 4, 6, 8, 10, 12, 14, 16, 18, 20 2'-deoxy-2'-fluoro ("2'-fluoro") ribonucleotide
  modified_base (1)..(21): Positions 2-3, 5, 7, 9, 11, 13, 15, 17, 19, 21 2'-O-methyl ribonucleotide
  modified_base (20)..(21): phosphorothioate linked nucleoside
ucugucucgcagacccagcuu

SEQ ID NO: 3939 - DNA, 21 bp, Artificial Sequence
  Synthetic polynucleotide
  modified_base (1)..(21): Positions 1-2, 4, 6, 8, 10, 12, 14, 16, 18, 20 2'-deoxy-2'-fluoro ("2'-fluoro") ribonucleotide
  modified_base (1)..(21): Positions 3, 5, 7, 9, 11, 13, 15, 17, 19, 21 2'-O-methyl ribonucleotide
  modified_base (20)..(21): phosphorothioate linked nucleoside
ucugucucgcagacccagcuu

SEQ ID NO: 3940 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
  modified_base (20)..(21): phosphorothioate linked nucleoside
ucugucucgcagacccagcuu

SEQ ID NO: 3941 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
  modified_base (20)..(21): phosphorothioate linked nucleoside
ucugucucgcagacccagcuu

SEQ ID NO: 3942 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
  modified_base (20)..(21): phosphorothioate linked nucleoside
ucugucucgcagacccagcuu

SEQ ID NO: 3943 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
  modified_base (20)..(21): phosphorothioate linked nucleoside
ucugucucgcagacccagcuu

SEQ ID NO: 3944 - DNA, 21 bp, Artificial Sequence
  Synthetic polynucleotide
  modified_base (21)..(21): phosphorothioate linked nucleoside
ugaaaauucccgagaaagctt

SEQ ID NO: 3945 - DNA, 21 bp, Artificial Sequence
  Synthetic polynucleotide
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (20)..(21): phosphorothioate linked nucleoside
ugaaaauucccgagaaagcuu

SEQ ID NO: 3946 - DNA, 21 bp, Artificial Sequence
  Synthetic polynucleotide
  modified_base (1)..(21): Positions 2, 4, 6, 8, 11, 14, 16, 18, 20 2'-deoxy-2'-fluoro ("2'-fluoro") ribonucleotide
  modified_base (1)..(21): Positions 1, 3, 5, 7, 9-10, 12-13, 15, 17, 19, 21 2'-O-methyl ribonucleotide
  modified_base (20)..(21): phosphorothioate linked nucleoside
ugaaaauucccgagaaagcuu

SEQ ID NO: 3947 - DNA, 21 bp, Artificial Sequence
  Synthetic polynucleotide
  modified_base (1)..(21): Positions 2, 4, 6, 8, 11-12, 14, 16, 18, 20 2'-deoxy-2'-fluoro ("2'-fluoro") ribonucleotide
  modified_base (1)..(21): Positions 1, 3, 5, 7, 9-10, 13, 15, 17, 19, 21 2'-O-methyl ribonucleotide
  modified_base (20)..(21): phosphorothioate linked nucleoside
ugaaaauucccgagaaagcuu

SEQ ID NO: 3948 - DNA, 21 bp, Artificial Sequence
  Synthetic polynucleotide
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (20)..(21): phosphorothioate linked nucleoside
ugaaaauucccgagaaagcuu

SEQ ID NO: 3949 - DNA, 21 bp, Artificial Sequence
  Synthetic polynucleotide
  modified_base (1)..(21): Positions 2, 4, 6, 9, 12, 14, 16, 18, 20 2'-deoxy-2'-fluoro ("2'-fluoro") ribonucleotide
  modified_base (1)..(21): Positions 1, 3, 5, 7-8, 10-11, 13, 15, 17, 19, 21 2'-O-methyl ribonucleotide
  modified_base (20)..(21): phosphorothioate linked nucleoside
ugaaaauucccgagaaagcuu

SEQ ID NO: 3950 - DNA, 21 bp, Artificial Sequence
  Synthetic polynucleotide
  modified_base (1)..(21): Positions 2, 4, 6, 8-9, 12, 14, 16, 18, 20 2'-deoxy-2'-fluoro ("2'-fluoro") ribonucleotide
  modified_base (1)..(21): Positions 1, 3, 5, 7, 10-11, 13, 15, 17, 19, 21 2'-O-methyl ribonucleotide
  modified_base (20)..(21): phosphorothioate linked nucleoside
ugaaaauucccgagaaagcuu

SEQ ID NO: 3951 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (20)..(21): phosphorothioate linked nucleoside
ugaaaauucccgagaaagcuu

SEQ ID NO: 3952 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (20)..(21): phosphorothioate linked nucleoside
ugaaaauucccgagaaagcuu

SEQ ID NO: 3953 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (1)..(21): Positions 2-3, 20-21 phosphorothioate linked nucleoside
ugaaaauucccgagaaagcuu

SEQ ID NO: 3954 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
ugaaaauucccgagaaagcuu

SEQ ID NO: 3955 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (1)..(21): Positions 2-3, 20-21 phosphorothioate linked nucleoside
ugaaaauucccgagaaagcuu

SEQ ID NO: 3956 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
ugaaaauucccgagaaagcuu

SEQ ID NO: 3957 - DNA, 21 bp, Artificial Sequence
  Synthetic polynucleotide
  modified_base (1)..(21): Positions 2, 4, 6, 8, 10, 12-13, 16, 18, 20 2'-deoxy-2'-fluoro ("2'-fluoro") ribonucleotide
  modified_base (1)..(21): Positions 1, 3, 5, 7, 9, 11, 14-15, 17, 19, 21 2'-O-methyl ribonucleotide
  modified_base (20)..(21): phosphorothioate linked nucleoside
ugaaaauucccgagaaagcuu

SEQ ID NO: 3958 - DNA, 21 bp, Artificial Sequence
  Synthetic polynucleotide
  modified_base (1)..(21): Positions 2, 4, 6, 8, 10, 12, 15-16, 18, 20 2'-deoxy-2'-fluoro ("2'-fluoro") ribonucleotide
  modified_base (1)..(21): Positions 1, 3, 5, 7, 9, 11, 13-14, 17, 19, 21 2'-O-methyl ribonucleotide
  modified_base (20)..(21): phosphorothioate linked nucleoside
ugaaaauucccgagaaagcuu

SEQ ID NO: 3959 - DNA, 21 bp, Artificial Sequence
  Synthetic polynucleotide
  modified_base (1)..(21): Positions 2, 4, 6, 8, 10, 12, 14-15, 18, 20 2'-deoxy-2'-fluoro ("2'-fluoro") ribonucleotide
  modified_base (1)..(21): Positions 1, 3, 5, 7, 9, 11, 13, 16-17, 19, 21
  modified_base (20)..(21): phosphorothioate linked nucleoside
ugaaaauucccgagaaagcuu

SEQ ID NO: 3960 - DNA, 21 bp, Artificial Sequence
  Synthetic polynucleotide
  modified_base (1)..(21): Positions 2, 4, 6, 8, 10, 12, 14, 17-18, 20 2'-deoxy-2'-fluoro ("2'-fluoro") ribonucleotide
  modified_base (1)..(21): Positions 1, 3, 5, 7, 9, 11, 13, 15-16, 19, 21 2'-O-methyl ribonucleotide
  modified_base (20)..(21): phosphorothioate linked nucleoside
ugaaaauucccgagaaagcuu

SEQ ID NO: 3961 - DNA, 21 bp, Artificial Sequence
  Synthetic polynucleotide
  modified_base (1)..(21): Positions 2, 4, 6, 8, 10, 12, 14, 16-17, 20 2'-deoxy-2'-fluoro ("2'-fluoro") ribonucleotide
  modified_base (1)..(21): Positions 1, 3, 5, 7, 9, 11, 13, 15, 18-19, 21 2'-O-methyl ribonucleotide
  modified_base (20)..(21): phosphorothioate linked nucleoside
ugaaaauucccgagaaagcuu

SEQ ID NO: 3962 - DNA, 21 bp, Artificial Sequence
  Synthetic polynucleotide
  modified_base (1)..(21): Positions 2, 4, 6, 8, 10, 12, 14, 16, 19-20 2'-deoxy-2'-fluoro ("2'-fluoro") ribonucleotide
  modified_base (1)..(21): Positions 1, 3, 5, 7, 9, 11, 13, 15, 17-18, 21 2'-O-methyl ribonucleotide
  modified_base (20)..(21): phosphorothioate linked nucleoside
ugaaaauucccgagaaagcuu

SEQ ID NO: 3963 - DNA, 21 bp, Artificial Sequence
  Synthetic polynucleotide
  modified_base (1)..(21): Positions 2, 4, 6, 8, 10, 12, 14, 16, 18-19 2'-deoxy-2'-fluoro ("2'-fluoro") ribonucleotide
  modified_base (1)..(21): Positions 1, 3, 5, 7, 9, 11, 13, 15, 17, 20-21 2'-O-methyl ribonucleotide
  modified_base (20)..(21): phosphorothioate linked nucleoside
ugaaaauucccgagaaagcuu

SEQ ID NO: 3964 - DNA, 21 bp, Artificial Sequence
  Synthetic polynucleotide
  modified_base (1)..(21): Positions 2, 4, 7-8, 10, 12, 14, 16, 18, 20 2'-deoxy-2'-fluoro ("2'-fluoro") ribonucleotide
  modified_base (1)..(21): Positions 1, 3, 5-6, 9, 11, 13, 15, 17, 19, 21 2'-O-methyl ribonucleotide
  modified_base (20)..(21): phosphorothioate linked nucleoside
ugaaaauucccgagaaagcuu

SEQ ID NO: 3965 - DNA, 21 bp, Artificial Sequence
  Synthetic polynucleotide
  modified_base (1)..(21): Positions 2, 4-5, 8, 10, 12, 14, 16, 18, 20 2'-deoxy-2'-fluoro ("2'-fluoro") ribonucleotide
  modified_base (1)..(21): Positions 1, 3, 6-7, 9, 11, 13, 15, 17, 19, 21 2'-O-methyl ribonucleotide
  modified_base (20)..(21): phosphorothioate linked nucleoside
ugaaaauucccgagaaagcuu

SEQ ID NO: 3966 - DNA, 21 bp, Artificial Sequence
  Synthetic polynucleotide
  modified_base (1)..(21): Positions 2, 5-6, 8, 10, 12, 14, 16, 18, 20 2'-deoxy-2'-fluoro ("2'-fluoro") ribonucleotide
  modified_base (1)..(21): Positions 1, 3-4, 7, 9, 11, 13, 15, 17, 19, 21 2'-O-methyl ribonucleotide
  modified_base (20)..(21): phosphorothioate linked nucleoside
ugaaaauucccgagaaagcuu

SEQ ID NO: 3967 - DNA, 21 bp, Artificial Sequence
  Synthetic polynucleotide
  modified_base (1)..(21): Positions 2-3, 6, 8, 10, 12, 14, 16, 18, 20 2'-deoxy-2'-fluoro ("2'-fluoro") ribonucleotide
  modified_base (1)..(21): Positions 1, 4-5, 7, 9, 11, 13, 15, 17, 19, 21 2'-O-methyl ribonucleotide
  modified_base (20)..(21): phosphorothioate linked nucleoside
ugaaaauucccgagaaagcuu

SEQ ID NO: 3968 - DNA, 21 bp, Artificial Sequence
  Synthetic polynucleotide
  modified_base (1)..(21): Positions 3-4, 6, 8, 10, 12, 14, 16, 18, 20 2'-deoxy-2'-fluoro ("2'-fluoro") ribonucleotide
  modified_base (1)..(21): Positions 1-2, 5, 7, 9, 11, 13, 15, 17, 19, 21 2'-O-methyl ribonucleotide
  modified_base (20)..(21): phosphorothioate linked nucleoside
ugaaaauucccgagaaagcuu

SEQ ID NO: 3969 - DNA, 21 bp, Artificial Sequence
  Synthetic polynucleotide
  modified_base (1)..(21): Positions 1, 4, 6, 8, 10, 12, 14, 16, 18, 20 2'-deoxy-2'-fluoro ("2'-fluoro") ribonucleotide
  modified_base (1)..(21): Positions 2-3, 5, 7, 9, 11, 13, 15, 17, 19, 21 2'-O-methyl ribonucleotide
  modified_base (20)..(21): phosphorothioate linked nucleoside
ugaaaauucccgagaaagcuu

SEQ ID NO: 3970 - DNA, 21 bp, Artificial Sequence
  Synthetic polynucleotide
  modified_base (1)..(21): Positions 1-2, 4, 6, 8, 10, 12, 14, 16, 18, 20 2'-deoxy-2'-fluoro ("2'-fluoro") ribonucleotide
  modified_base (1)..(21): Positions 3, 5, 7, 9, 11, 13, 15, 17, 19, 21 2'-O-methyl ribonucleotide
  modified_base (20)..(21): phosphorothioate linked nucleoside
ugaaaauucccgagaaagcuu

SEQ ID NO: 3971 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
  modified_base (20)..(21): phosphorothioate linked nucleoside
ugaaaauucccgagaaagcuu

SEQ ID NO: 3972 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
  modified_base (20)..(21): phosphorothioate linked nucleoside
ugaaaauucccgagaaagcuu

SEQ ID NO: 3973 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
  modified_base (20)..(21): phosphorothioate linked nucleoside
ugaaaauucccgagaaagcuu

SEQ ID NO: 3974 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
  modified_base (20)..(21): phosphorothioate linked nucleoside
ugaaaauucccgagaaagcuu

SEQ ID NO: 3975 - DNA, 21 bp, Artificial Sequence
  Synthetic polynucleotide
  modified_base (1)..(21): Positions 4, 6, 10, 13 2'-O-methyl ribonucleotide
  modified_base (21)..(21): phosphorothioate linked nucleoside
aaccacaagcagcaggaggtt

SEQ ID NO: 3976 - DNA, 21 bp, Artificial Sequence
  Synthetic polynucleotide
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (20)..(21): phosphorothioate linked nucleoside
aaccacaagcagcaggagguu

SEQ ID NO: 3977 - DNA, 21 bp, Artificial Sequence
  Synthetic polynucleotide
  modified_base (1)..(21): Positions 2, 4, 6, 8, 11, 14, 16, 18, 20 2'-deoxy-2'-fluoro ("2'-fluoro") ribonucleotide
  modified_base (1)..(21): Positions 1, 3, 5, 7, 9-10, 12-13, 15, 17, 19, 21 2'-O-methyl ribonucleotide
  modified_base (20)..(21): Synthetic polynucleotide
aaccacaagcagcaggagguu

SEQ ID NO: 3978 - DNA, 21 bp, Artificial Sequence
  Synthetic polynucleotide
  modified_base (1)..(21): Positions 2, 4, 6, 8, 11-12, 14, 16, 18, 20 2'-deoxy-2'-fluoro ("2'-fluoro") ribonucleotide
  modified_base (1)..(21): Positions 1, 3, 5, 7, 9-10, 13, 15, 17, 19, 21 2'-O-methyl ribonucleotide
  modified_base (20)..(21): phosphorothioate linked nucleoside
aaccacaagcagcaggagguu

SEQ ID NO: 3979 - DNA, 21 bp, Artificial Sequence
  Synthetic polynucleotide
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (20)..(21): phosphorothioate linked nucleoside
aaccacaagcagcaggagguu

SEQ ID NO: 3980 - DNA, 21 bp, Artificial Sequence
  Synthetic polynucleotide
  modified_base (1)..(21): Positions 2, 4, 6, 9, 12, 14, 16, 18, 20 2'-deoxy-2'-fluoro ("2'-fluoro") ribonucleotide
  modified_base (1)..(21): Positions 1, 3, 5, 7-8, 10-11, 13, 15, 17, 19, 21 2'-O-methyl ribonucleotide
  modified_base (20)..(21): phosphorothioate linked nucleoside
aaccacaagcagcaggagguu

SEQ ID NO: 3981 - DNA, 21 bp, Artificial Sequence
  Synthetic polynucleotide
  modified_base (1)..(21): Positions 2, 4, 6, 8-9, 12, 14, 16, 18, 20 2'-deoxy-2'-fluoro ("2'-fluoro") ribonucleotide
  modified_base (1)..(21): Positions 1, 3, 5, 7, 10-11, 13, 15, 17, 19, 21 2'-O-methyl ribonucleotide
  modified_base (20)..(21): phosphorothioate linked nucleoside
aaccacaagcagcaggagguu

SEQ ID NO: 3982 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (20)..(21): phosphorothioate linked nucleoside
aaccacaagcagcaggagguu

SEQ ID NO: 3983 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (20)..(21): phosphorothioate linked nucleoside
aaccacaagcagcaggagguu

SEQ ID NO: 3984 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (1)..(21): Positions 2-3, 20-21 phosphorothioate linked nucleoside
aaccacaagcagcaggagguu

SEQ ID NO: 3985 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
aaccacaagcagcaggagguu

SEQ ID NO: 3986 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (1)..(21): Positions 2-3, 20-21 phosphorothioate linked nucleoside
aaccacaagcagcaggagguu

SEQ ID NO: 3987 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
aaccacaagcagcaggagguu

SEQ ID NO: 3988 - DNA, 21 bp, Artificial Sequence
  Synthetic polynucleotide
  modified_base (1)..(21): Positions 2, 4, 6, 8, 10, 12-13, 16, 18, 20 2'-deoxy-2'-fluoro ("2'-fluoro") ribonucleotide
  modified_base (1)..(21): Positions 1, 3, 5, 7, 9, 11, 14-15, 17, 19, 21 2'-O-methyl ribonucleotide
aaccacaagcagcaggagguu

SEQ ID NO: 3989 - DNA, 21 bp, Artificial Sequence
  Synthetic polynucleotide
  modified_base (1)..(21): Positions 2, 4, 6, 8, 10, 12, 15-16, 18, 20 2'-deoxy-2'-fluoro ("2'-fluoro") ribonucleotide
  modified_base (1)..(21): Positions 1, 3, 5, 7, 9, 11, 13-14, 17, 19, 21 2'-O-methyl ribonucleotide
  modified_base (20)..(21): phosphorothioate linked nucleoside
aaccacaagcagcaggagguu

SEQ ID NO: 3990 - DNA, 21 bp, Artificial Sequence
  Synthetic polynucleotide
  modified_base (1)..(21): Positions 2, 4, 6, 8, 10, 12, 14-15, 18, 20 2'-deoxy-2'-fluoro ("2'-fluoro") ribonucleotide
  modified_base (1)..(21): Positions 1, 3, 5, 7, 9, 11, 13, 16-17, 19, 21 2'-O-methyl ribonucleotide
  modified_base (20)..(21): phosphorothioate linked nucleoside
aaccacaagcagcaggagguu

SEQ ID NO: 3991 - DNA, 21 bp, Artificial Sequence
  Synthetic polynucleotide
  modified_base (1)..(21): ons 2, 4, 6, 8, 10, 12, 14, 17-18, 20 2'-deoxy-2'-fluoro ("2'-fluoro") ribonucleotide
  modified_base (1)..(21): Positions 1, 3, 5, 7, 9, 11, 13, 15-16, 19, 21 2'-O-methyl ribonucleotide
  modified_base (20)..(21): phosphorothioate linked nucleoside
aaccacaagcagcaggagguu

SEQ ID NO: 3992 - DNA, 21 bp, Artificial Sequence
  Synthetic polynucleotide
  modified_base (1)..(21): Positions 2, 4, 6, 8, 10, 12, 14, 16-17, 20 2'-deoxy-2'-fluoro ("2'-fluoro") ribonucleotide
  modified_base (1)..(21): Positions 1, 3, 5, 7, 9, 11, 13, 15, 18-19, 21 2'-O-methyl ribonucleotide
  modified_base (20)..(21): phosphorothioate linked nucleoside
aaccacaagcagcaggagguu

SEQ ID NO: 3993 - DNA, 21 bp, Artificial Sequence
  Synthetic polynucleotide
  modified_base (1)..(21): Positions 2, 4, 6, 8, 10, 12, 14, 16, 19-20 2'-deoxy-2'-fluoro ("2'-fluoro") ribonucleotide
  modified_base (1)..(21): Positions 1, 3, 5, 7, 9, 11, 13, 15, 17-18, 21 2'-O-methyl ribonucleotide
  modified_base (20)..(21): phosphorothioate linked nucleoside
aaccacaagcagcaggagguu

SEQ ID NO: 3994 - DNA, 21 bp, Artificial Sequence
  Synthetic polynucleotide
  modified_base (1)..(21): Positions 2, 4, 6, 8, 10, 12, 14, 16, 18-19 2'-deoxy-2'-fluoro ("2'-fluoro") ribonucleotide
  modified_base (1)..(21): Positions 1, 3, 5, 7, 9, 11, 13, 15, 17, 20-21 2'-O-methyl ribonucleotide
  modified_base (1)..(21): Positions 1, 3, 5, 7, 9, 11, 13, 15, 17, 20-21 2'-O-methyl ribonucleotide
  modified_base (20)..(21): phosphorothioate linked nucleoside
aaccacaagcagcaggagguu

SEQ ID NO: 3995 - DNA, 21 bp, Artificial Sequence
  Synthetic polynucleotide
  modified_base (1)..(21): Positions 2, 4, 7-8, 10, 12, 14, 16, 18, 20 2'-deoxy-2'-fluoro ("2'-fluoro") ribonucleotide
  modified_base (1)..(21): Positions 1, 3, 5-6, 9, 11, 13, 15, 17, 19, 21 2'-O-methyl ribonucleotide
  modified_base (20)..(21): phosphorothioate linked nucleoside
aaccacaagcagcaggagguu

SEQ ID NO: 3996 - DNA, 21 bp, Artificial Sequence
  Synthetic polynucleotide
  modified_base (1)..(21): Positions 2, 4-5, 8, 10, 12, 14, 16, 18, 20 2'-deoxy-2'-fluoro ("2'-fluoro") ribonucleotide
  modified_base (1)..(21): Positions 1, 3, 6-7, 9, 11, 13, 15, 17, 19, 21 2'-O-methyl ribonucleotide
  modified_base (20)..(21): phosphorothioate linked nucleoside
aaccacaagcagcaggagguu

SEQ ID NO: 3997 - DNA, 21 bp, Artificial Sequence
  Synthetic polynucleotide
  modified_base (1)..(21): Positions 2, 5-6, 8, 10, 12, 14, 16, 18, 20 2'-deoxy-2'-fluoro ("2'-fluoro") ribonucleotide
  modified_base (1)..(21): Positions 1, 3-4, 7, 9, 11, 13, 15, 17, 19, 21 2'-O-methyl ribonucleotide
  modified_base (20)..(21): phosphorothioate linked nucleoside
aaccacaagcagcaggagguu

SEQ ID NO: 3998 - DNA, 21 bp, Artificial Sequence
  Synthetic polynucleotide
  modified_base (1)..(21): Positions 2-3, 6, 8, 10, 12, 14, 16, 18, 20 2'-deoxy-2'-fluoro ("2'-fluoro") ribonucleotide
  modified_base (1)..(21): Positions 1, 4-5, 7, 9, 11, 13, 15, 17, 19, 21 2'-O-methyl ribonucleotide
  modified_base (20)..(21): phosphorothioate linked nucleoside
aaccacaagcagcaggagguu

SEQ ID NO: 3999 - DNA, 21 bp, Artificial Sequence
  Synthetic polynucleotide
  modified_base (1)..(21): Positions 3-4, 6, 8, 10, 12, 14, 16, 18, 20 2'-deoxy-2'-fluoro ("2'-fluoro") ribonucleotide
  modified_base (1)..(21): Positions 1-2, 5, 7, 9, 11, 13, 15, 17, 19, 21 2'-O-methyl ribonucleotide
  modified_base (20)..(21): phosphorothioate linked nucleoside
aaccacaagcagcaggagguu

SEQ ID NO: 4000 - DNA, 21 bp, Artificial Sequence
  Synthetic polynucleotide
  modified_base (1)..(21): Positions 1, 4, 6, 8, 10, 12, 14, 16, 18, 20 2'-deoxy-2'-fluoro ("2'-fluoro") ribonucleotide
  modified_base (1)..(21): Positions 2-3, 5, 7, 9, 11, 13, 15, 17, 19, 21 2'-O-methyl ribonucleotide
  modified_base (20)..(21): phosphorothioate linked nucleoside
aaccacaagcagcaggagguu

SEQ ID NO: 4001 - DNA, 21 bp, Artificial Sequence
  Synthetic polynucleotide
  modified_base (1)..(21): Positions 1-2, 4, 6, 8, 10, 12, 14, 16, 18, 20 2'-deoxy-2'-fluoro ("2'-fluoro") ribonucleotide
  modified_base (1)..(21): Positions 3, 5, 7, 9, 11, 13, 15, 17, 19, 21 2'-O-methyl ribonucleotide
  modified_base (20)..(21): phosphorothioate linked nucleoside
aaccacaagcagcaggagguu

SEQ ID NO: 4002 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
  modified_base (20)..(21): phosphorothioate linked nucleoside
aaccacaagcagcaggagguu

SEQ ID NO: 4003 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
  modified_base (20)..(21): phosphorothioate linked nucleoside
aaccacaagcagcaggagguu

SEQ ID NO: 4004 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
  modified_base (20)..(21): phosphorothioate linked nucleoside
aaccacaagcagcaggagguu

SEQ ID NO: 4005 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
  modified_base (20)..(21): phosphorothioate linked nucleoside
aaccacaagcagcaggagguu

SEQ ID NO: 4006 - DNA, 21 bp, Artificial Sequence
  Synthetic polynucleotide
  modified_base (1)..(21): Positions 1, 12, 17 2'-O-methyl ribonucleotide
  modified_base (21)..(21): phosphorothioate linked nucleoside
uacuccuuggucaugauagtt

SEQ ID NO: 4007 - DNA, 21 bp, Artificial Sequence
  Synthetic polynucleotide
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (20)..(21): phosphorothioate linked nucleoside
uacuccuuggucaugauaguu

SEQ ID NO: 4008 - DNA, 21 bp, Artificial Sequence
  Synthetic polynucleotide
  modified_base (1)..(21): Positions 2, 4, 6, 8, 11, 14, 16, 18, 20 2'-deoxy-2'-fluoro ("2'-fluoro") ribonucleotide
  modified_base (1)..(21): Positions 1, 3, 5, 7, 9,-10, 12-13, 15, 17, 19, 21 2'-O-methyl ribonucleotide
  modified_base (20)..(21): phosphorothioate linked nucleoside
uacuccuuggucaugauaguu

SEQ ID NO: 4009 - DNA, 21 bp, Artificial Sequence
  Synthetic polynucleotide
  modified_base (1)..(21): Positions 2, 4, 6, 8, 11-12, 14, 16, 18, 20 2'-deoxy-2'-fluoro ("2'-fluoro") ribonucleotide
  modified_base (1)..(21): Positions 1, 3, 5, 7, 9-10, 13, 15, 17, 19, 21 2'-O-methyl ribonucleotide
  modified_base (20)..(21): phosphorothioate linked nucleoside
uacuccuuggucaugauaguu

SEQ ID NO: 4010 - DNA, 21 bp, Artificial Sequence
  Synthetic polynucleotide
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (20)..(21): phosphorothioate linked nucleoside
uacuccuuggucaugauaguu

SEQ ID NO: 4011 - DNA, 21 bp, Artificial Sequence
  Synthetic polynucleotide
  modified_base (1)..(21): Positions 2, 4, 6, 9, 12, 14, 16, 18, 20 2'-deoxy-2'-fluoro ("2'-fluoro") ribonucleotide
  modified_base (1)..(21): Positions 1, 3, 5, 7-8, 10-11, 13, 15, 17, 19, 21 2'-O-methyl ribonucleotide
  modified_base (20)..(21): phosphorothioate linked nucleoside
uacuccuuggucaugauaguu

SEQ ID NO: 4012 - DNA, 21 bp, Artificial Sequence
  Synthetic polynucleotide
  modified_base (1)..(21): Positions 2, 4, 6, 8-9, 12, 14, 16, 18, 20 2'-deoxy-2'-fluoro ("2'-fluoro") ribonucleotide
  modified_base (1)..(21): Positions 1, 3, 5, 7, 10-11, 13, 15, 17, 19, 21 2'-O-methyl ribonucleotide
  modified_base (20)..(21): phosphorothioate linked nucleoside
uacuccuuggucaugauaguu

SEQ ID NO: 4013 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (20)..(21): phosphorothioate linked nucleoside
uacuccuuggucaugauaguu

SEQ ID NO: 4014 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (20)..(21): phosphorothioate linked nucleoside
uacuccuuggucaugauaguu

SEQ ID NO: 4015 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (1)..(21): Positions 2-3, 20-21 phosphorothioate linked nucleoside
uacuccuuggucaugauaguu

SEQ ID NO: 4016 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
uacuccuuggucaugauaguu

SEQ ID NO: 4017 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (1)..(21): Positions 2-3, 20-21 phosphorothioate linked nucleoside
uacuccuuggucaugauaguu

SEQ ID NO: 4018 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
uacuccuuggucaugauaguu

SEQ ID NO: 4019 - DNA, 21 bp, Artificial Sequence
  Synthetic polynucleotide
  modified_base (1)..(21): Positions 2, 4, 6, 8, 10, 12-13, 16, 18, 20 2'-deoxy-2'-fluoro ("2'-fluoro") ribonucleotide
  modified_base (1)..(21): Positions 1, 3, 5, 7, 9, 11, 14-15, 17, 19, 21 2'-O-methyl ribonucleotide
  modified_base (20)..(21): phosphorothioate linked nucleoside
uacuccuuggucaugauaguu

SEQ ID NO: 4020 - DNA, 21 bp, Artificial Sequence
  Synthetic polynucleotide
  modified_base (1)..(21): Positions 2, 4, 6, 8, 10, 12, 15-16, 18, 20 2'-deoxy-2'-fluoro ("2'-fluoro") ribonucleotide
  modified_base (1)..(21): Positions 1, 3, 5, 7, 9, 11, 13-14, 17, 19, 21 2'-O-methyl ribonucleotide
  modified_base (20)..(21): phosphorothioate linked nucleoside
uacuccuuggucaugauaguu

SEQ ID NO: 4021 - DNA, 21 bp, Artificial Sequence
  Synthetic polynucleotide
  modified_base (1)..(21): Positions 2, 4, 6, 8, 10, 12, 14-15, 18, 20 2'-deoxy-2'-fluoro ("2'-fluoro") ribonucleotide
  modified_base (1)..(21): Positions 1, 3, 5, 7, 9, 11, 13, 16-17, 19, 21 2'-O-methyl ribonucleotide
  modified_base (20)..(21): phosphorothioate linked nucleoside
uacuccuuggucaugauaguu

SEQ ID NO: 4022 - DNA, 21 bp, Artificial Sequence
  Synthetic polynucleotide
  modified_base (1)..(21): Positions 2, 4, 6, 8, 10, 12, 14, 17-18, 20 2'-deoxy-2'-fluoro ("2'-fluoro") ribonucleotide
  modified_base (1)..(21): Positions 1, 3, 5, 7, 9, 11, 13, 15-16, 19, 21 2'-O-methyl ribonucleotide
  modified_base (20)..(21): phosphorothioate linked nucleoside
uacuccuuggucaugauaguu

SEQ ID NO: 4023 - DNA, 21 bp, Artificial Sequence
  Synthetic polynucleotide
  modified_base (1)..(21): Positions 2, 4, 6, 8, 10, 12, 14, 16-17, 20 2'-deoxy-2'-fluoro ("2'-fluoro") ribonucleotide
  modified_base (1)..(21): Positions 1, 3, 5, 7, 9, 11, 13, 15, 17, 18-19 2'-O-methyl ribonucleotide
  modified_base (20)..(21): phosphorothioate linked nucleoside
uacuccuuggucaugauaguu

SEQ ID NO: 4024 - DNA, 21 bp, Artificial Sequence
  Synthetic polynucleotide
  modified_base (1)..(21): Positions 2, 4, 6, 8, 10, 12, 14, 16, 19-20 2'-deoxy-2'-fluoro ("2'-fluoro") ribonucleotide
  modified_base (1)..(21): Positions 1, 3, 5, 7, 9, 11, 13, 15, 17-18, 21 2'-O-methyl ribonucleotide
  modified_base (20)..(21): phosphorothioate linked nucleoside
uacuccuuggucaugauaguu

SEQ ID NO: 4025 - DNA, 21 bp, Artificial Sequence
  Synthetic polynucleotide
  modified_base (1)..(21): Positions 2, 4, 6, 8, 10, 12, 14, 16, 18-19 2'-deoxy-2'-fluoro ("2'-fluoro") ribonucleotide
  modified_base (1)..(21): Positions 1, 3, 5, 7, 9, 11, 13, 15, 17, 20-21 2'-O-methyl ribonucleotide
  modified_base (20)..(21): phosphorothioate linked nucleoside
uacuccuuggucaugauaguu

SEQ ID NO: 4026 - DNA, 21 bp, Artificial Sequence
  Synthetic polynucleotide
  modified_base (1)..(21): Positions 2, 4, 7-8, 10, 12, 14, 16, 18, 20 2'-deoxy-2'-fluoro ("2'-fluoro") ribonucleotide
  modified_base (1)..(21): Positions 1, 3, 5-6, 9, 11, 13, 15, 17, 19, 21 2'-O-methyl ribonucleotide
  modified_base (20)..(21): phosphorothioate linked nucleoside
uacuccuuggucaugauaguu

SEQ ID NO: 4027 - DNA, 21 bp, Artificial Sequence
  Synthetic polynucleotide
  modified_base (1)..(21): Positions 2, 4-5, 8, 10, 12, 14, 16, 18, 20 2'-deoxy-2'-fluoro ("2'-fluoro") ribonucleotide
  modified_base (1)..(21): Positions 1, 3, 6-7, 9, 11, 13, 15, 17, 19, 21 2'-O-methyl ribonucleotide
  modified_base (20)..(21): phosphorothioate linked nucleoside
uacuccuuggucaugauaguu

SEQ ID NO: 4028 - DNA, 21 bp, Artificial Sequence
  Synthetic polynucleotide
  modified_base (1)..(21): Positions 2, 5-6, 8, 10, 12, 14, 16, 18, 20 2'-deoxy-2'-fluoro ("2'-fluoro") ribonucleotide
  modified_base (1)..(21): Positions 1, 3-4, 7, 9, 11, 13, 15, 17, 19, 21 2'-O-methyl ribonucleotide
  modified_base (20)..(21): phosphorothioate linked nucleoside
uacuccuuggucaugauaguu

SEQ ID NO: 4029 - DNA, 21 bp, Artificial Sequence
  Synthetic polynucleotide
  modified_base (1)..(21): Positions 2-3, 6, 8, 10, 12, 14, 16, 18, 20 2'-deoxy-2'-fluoro ("2'-fluoro") ribonucleotide
  modified_base (1)..(21): Positions 1, 4-5, 7, 9, 11, 13, 15, 17, 19, 21 2'-O-methyl ribonucleotide
  modified_base (20)..(21): phosphorothioate linked nucleoside
uacuccuuggucaugauaguu

SEQ ID NO: 4030 - DNA, 21 bp, Artificial Sequence
  Synthetic polynucleotide
  modified_base (1)..(21): Positions 3-4, 6, 8, 10, 12, 14, 16, 18, 20 2'-deoxy-2'-fluoro ("2'-fluoro") ribonucleotide
  modified_base (1)..(21): Positions 1-2, 5, 7, 9, 11, 13, 15, 17, 19, 21 2'-O-methyl ribonucleotide
  modified_base (20)..(21): phosphorothioate linked nucleoside
uacuccuuggucaugauaguu

SEQ ID NO: 4031 - DNA, 21 bp, Artificial Sequence
  Synthetic polynucleotide
  modified_base (1)..(21): Positions 1, 4, 6, 8, 10, 12, 14, 16, 18, 20 2'-deoxy-2'-fluoro ("2'-fluoro") ribonucleotide
  modified_base (1)..(21): Positions 2-3, 5, 7, 9, 11, 13, 15, 17, 19, 21 2'-O-methyl ribonucleotide
  modified_base (20)..(21): phosphorothioate linked nucleoside
uacuccuuggucaugauaguu

SEQ ID NO: 4032 - DNA, 21 bp, Artificial Sequence
  Synthetic polynucleotide
  modified_base (1)..(21): Positions 1-2, 4, 6, 8, 10, 12, 14, 16, 18, 20 2'-deoxy-2'-fluoro ("2'-fluoro") ribonucleotide
  modified_base (1)..(21): Positions 3, 5, 7, 9, 11, 13, 15, 17, 19, 21 2'-O-methyl ribonucleotide
  modified_base (20)..(21): phosphorothioate linked nucleoside
uacuccuuggucaugauaguu

SEQ ID NO: 4033 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
  modified_base (20)..(21): phosphorothioate linked nucleoside
uacuccuuggucaugauaguu

SEQ ID NO: 4034 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
  modified_base (20)..(21): phosphorothioate linked nucleoside
uacuccuuggucaugauaguu

SEQ ID NO: 4035 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
  modified_base (20)..(21): phosphorothioate linked nucleoside
uacuccuuggucaugauaguu

SEQ ID NO: 4036 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
  modified_base (20)..(21): phosphorothioate linked nucleoside
uacuccuuggucaugauaguu

SEQ ID NO: 4037 - DNA, 21 bp, Artificial Sequence
  Synthetic polynucleotide
  modified_base (13)..(13): 2'-O-methyl ribonucleotide
  modified_base (21)..(21): phosphorothioate linked nucleoside
uucugcuccucccaggacgtt

SEQ ID NO: 4038 - DNA, 21 bp, Artificial Sequence
  Synthetic polynucleotide
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (20)..(21): phosphorothioate linked nucleoside
uucugcuccucccaggacguu

SEQ ID NO: 4039 - DNA, 21 bp, Artificial Sequence
  Synthetic polynucleotide
  modified_base (1)..(21): Positions 2, 4, 6, 8, 11, 14, 16, 18, 20 2'-deoxy-2'-fluoro ("2'-fluoro") ribonucleotide
  modified_base (1)..(21): Positions 1, 3, 5, 7, 9-10, 12-13, 15, 17, 19, 21 2'-O-methyl ribonucleotide
  modified_base (20)..(21): phosphorothioate linked nucleoside
uucugcuccucccaggacguu

SEQ ID NO: 4040 - DNA, 21 bp, Artificial Sequence
  Synthetic polynucleotide
  modified_base (1)..(21): Positions 2, 4, 6, 8, 11-12, 14, 16, 18, 20 2'-deoxy-2'-fluoro ("2'-fluoro") ribonucleotide
  modified_base (1)..(21): Positions 1, 3, 5, 7, 9-10, 13, 15, 17, 19, 21 2'-O-methyl ribonucleotide
  modified_base (20)..(21): phosphorothioate linked nucleoside
uucugcuccucccaggacguu

SEQ ID NO: 4041 - DNA, 21 bp, Artificial Sequence
  Synthetic polynucleotide
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (20)..(21): phosphorothioate linked nucleoside
uucugcuccucccaggacguu

SEQ ID NO: 4042 - DNA, 21 bp, Artificial Sequence
  Synthetic polynucleotide
  modified_base (1)..(21): Positions 2, 4, 6, 8, 9, 12, 14, 16, 18, 20 2'-deoxy-2'-fluoro ("2'-fluoro") ribonucleotide
  modified_base (1)..(21): Positions 1, 3, 5, 7-8, 10-11, 13, 15, 17, 19, 21 2'-O-methyl ribonucleotide
  modified_base (20)..(21): phosphorothioate linked nucleoside
uucugcuccucccaggacguu

SEQ ID NO: 4043 - DNA, 21 bp, Artificial Sequence
  Synthetic polynucleotide
  modified_base (1)..(21): Positions 2, 4, 6, 8-9, 12, 14, 16, 18, 20 2'-deoxy-2'-fluoro ("2'-fluoro") ribonucleotide
  modified_base (1)..(21): Positions 1, 3, 5, 7, 10-11, 13, 15, 17, 19, 21 2'-O-methyl ribonucleotide
  modified_base (20)..(21): phosphorothioate linked nucleoside
uucugcuccucccaggacguu

SEQ ID NO: 4044 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (20)..(21): phosphorothioate linked nucleoside
uucugcuccucccaggacguu

SEQ ID NO: 4045 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (20)..(21): phosphorothioate linked nucleoside
uucugcuccucccaggacguu

SEQ ID NO: 4046 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (1)..(21): Positions 2-3, 20-21 phosphorothioate linked nucleoside
uucugcuccucccaggacguu

SEQ ID NO: 4047 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
uucugcuccucccaggacguu

SEQ ID NO: 4048 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (1)..(21): Positions 2-3, 20-21 phosphorothioate linked nucleoside
uucugcuccucccaggacguu

SEQ ID NO: 4049 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
uucugcuccucccaggacguu

SEQ ID NO: 4050 - DNA, 21 bp, Artificial Sequence
  Synthetic polynucleotide
  modified_base (1)..(21): Positions 2, 4, 6, 8, 10, 12-13, 16, 18, 20 2'-deoxy-2'-fluoro ("2'-fluoro") ribonucleotide
  modified_base (1)..(21): Positions 1, 3, 5, 7, 9, 11, 14-15, 17, 19, 21 2'-O-methyl ribonucleotide
  modified_base (20)..(21): phosphorothioate linked nucleoside
uucugcuccucccaggacguu

SEQ ID NO: 4051 - DNA, 21 bp, Artificial Sequence
  Synthetic polynucleotide
  modified_base (1)..(21): Positions 2, 4, 6, 8, 10, 12, 15-16, 18, 20 2'-deoxy-2'-fluoro ("2'-fluoro") ribonucleotide
  modified_base (1)..(21): Positions 1, 3, 5, 7, 9, 11, 13-14, 17, 19, 21 2'-O-methyl ribonucleotide
  modified_base (20)..(21): phosphorothioate linked nucleoside
uucugcuccucccaggacguu

SEQ ID NO: 4052 - DNA, 21 bp, Artificial Sequence
  Synthetic polynucleotide
  modified_base (1)..(21): Positions 2, 4, 6, 8, 10, 12, 14-15, 18, 20 2'-deoxy-2'-fluoro ("2'-fluoro") ribonucleotide
  modified_base (1)..(21): Positions 1, 3, 5, 7, 9, 11, 13, 16-17, 19, 21 2'-O-methyl ribonucleotide
  modified_base (20)..(21): phosphorothioate linked nucleoside
uucugcuccucccaggacguu

SEQ ID NO: 4053 - DNA, 21 bp, Artificial Sequence
  Synthetic polynucleotide
  modified_base (1)..(21): Positions 2, 4, 6, 8, 10, 12, 14, 17-18, 20 2'-deoxy-2'-fluoro ("2'-fluoro") ribonucleotide
  modified_base (1)..(21): Positions 1, 3, 5, 7, 9, 11, 13, 15-16, 19, 21 2'-O-methyl ribonucleotide
  modified_base (20)..(21): phosphorothioate linked nucleoside
uucugcuccucccaggacguu

SEQ ID NO: 4054 - DNA, 21 bp, Artificial Sequence
  Synthetic polynucleotide
  modified_base (1)..(21): Positions 2, 4, 6, 8, 10, 12, 14, 16-17, 20 2'-deoxy-2'-fluoro ("2'-fluoro") ribonucleotide
  modified_base (1)..(21): Positions 1, 3, 5, 7, 9, 11, 13, 15, 18-19, 21 2'-O-methyl ribonucleotide
  modified_base (20)..(21): phosphorothioate linked nucleoside
uucugcuccucccaggacguu

SEQ ID NO: 4055 - DNA, 21 bp, Artificial Sequence
  Synthetic polynucleotide
  modified_base (1)..(21): Positions 2, 4, 6, 8, 10, 12, 14, 16, 19-20 2'-deoxy-2'-fluoro ("2'-fluoro") ribonucleotide
  modified_base (1)..(21): Positions 1, 3, 5, 7, 9, 11, 13, 15, 17-18, 21 2'-O-methyl ribonucleotide
  modified_base (20)..(21): phosphorothioate linked nucleoside
uucugcuccucccaggacguu

SEQ ID NO: 4056 - DNA, 21 bp, Artificial Sequence
  Synthetic polynucleotide
  modified_base (1)..(21): Positions 2, 4, 6, 8, 10, 12, 14, 16, 18-19 2'-deoxy-2'-fluoro ("2'-fluoro") ribonucleotide
  modified_base (1)..(21): Positions 1, 3, 5, 7, 9, 11, 13, 15, 17, 20-21 2'-O-methyl ribonucleotide
  modified_base (20)..(21): phosphorothioate linked nucleoside
uucugcuccucccaggacguu

SEQ ID NO: 4057 - DNA, 21 bp, Artificial Sequence
  Synthetic polynucleotide
  modified_base (1)..(21): Positions 2, 4, 7-8, 10, 12, 14, 16, 18, 20 2'-deoxy-2'-fluoro ("2'-fluoro") ribonucleotide
  modified_base (1)..(21): Positions 1, 3, 5-6, 9, 11, 13, 15, 17, 19, 21 2'-O-methyl ribonucleotide
  modified_base (20)..(21): phosphorothioate linked nucleoside
uucugcuccucccaggacguu

SEQ ID NO: 4058 - DNA, 21 bp, Artificial Sequence
  Synthetic polynucleotide
  modified_base (1)..(21): Positions 2, 4-5, 8, 10, 12, 14, 16, 18, 20 2'-deoxy-2'-fluoro ("2'-fluoro") ribonucleotide
  modified_base (1)..(21): Positions 1, 3, 6-7, 9, 11, 13, 15, 17, 19, 21 2'-O-methyl ribonucleotide
  modified_base (20)..(21): phosphorothioate linked nucleoside
uucugcuccucccaggacguu

SEQ ID NO: 4059 - DNA, 21 bp, Artificial Sequence
  Synthetic polynucleotide
  modified_base (1)..(21): Positions 2, 5-6, 8, 10, 12, 14, 16, 18, 20 2'-deoxy-2'-fluoro ("2'-fluoro") ribonucleotide
  modified_base (1)..(21): Positions 1, 3-4, 7, 9, 11, 13, 15, 17, 19, 21 2'-O-methyl ribonucleotide
  modified_base (20)..(21): phosphorothioate linked nucleoside
uucugcuccucccaggacguu

SEQ ID NO: 4060 - DNA, 21 bp, Artificial Sequence
  Synthetic polynucleotide
  modified_base (1)..(21): Positions 2-3, 6, 8, 10, 12, 14, 16, 18, 20 2'-deoxy-2'-fluoro ("2'-fluoro") ribonucleotide
  modified_base (1)..(21): Positions 1, 4-5, 7, 9, 11, 13, 15, 17, 19, 21 2'-O-methyl ribonucleotide
  modified_base (20)..(21): phosphorothioate linked nucleoside
uucugcuccucccaggacguu

SEQ ID NO: 4061 - DNA, 21 bp, Artificial Sequence
  Synthetic polynucleotide
  modified_base (1)..(21): Positions 3-4, 6, 8, 10, 12, 14, 16, 18, 20 2'-deoxy-2'-fluoro ("2'-fluoro") ribonucleotide
  modified_base (1)..(21): Positions 1-2, 5, 7, 9, 11, 13, 15, 17, 19, 21 2'-O-methyl ribonucleotide
  modified_base (20)..(21): phosphorothioate linked nucleoside
uucugcuccucccaggacguu

SEQ ID NO: 4062 - DNA, 21 bp, Artificial Sequence
  Synthetic polynucleotide
  modified_base (1)..(21): Positions 1, 4, 6, 8, 10, 12, 14, 16, 18, 20 2'-deoxy-2'-fluoro ("2'-fluoro") ribonucleotide
  modified_base (1)..(21): Positions 2-3, 5, 7, 9, 11, 13, 15, 17, 19, 21 2'-O-methyl ribonucleotide
  modified_base (20)..(21): phosphorothioate linked nucleoside
uucugcuccucccaggacguu

SEQ ID NO: 4063 - DNA, 21 bp, Artificial Sequence
  Synthetic polynucleotide
  modified_base (1)..(21): Positions 1-2, 4, 6, 8, 10, 12, 14, 16, 18, 20 2'-deoxy-2'-fluoro ("2'-fluoro") ribonucleotide
  modified_base (1)..(21): Positions 3, 5, 7, 9, 11, 13, 15, 17, 19, 21 2'-O-methyl ribonucleotide
  modified_base (20)..(21): phosphorothioate linked nucleoside
uucugcuccucccaggacguu

SEQ ID NO: 4064 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
  modified_base (20)..(21): phosphorothioate linked nucleoside
uucugcuccucccaggacguu

SEQ ID NO: 4065 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
  modified_base (20)..(21): phosphorothioate linked nucleoside
uucugcuccucccaggacguu

SEQ ID NO: 4066 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
  modified_base (20)..(21): phosphorothioate linked nucleoside
uucugcuccucccaggacguu

SEQ ID NO: 4067 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
  modified_base (20)..(21): phosphorothioate linked nucleoside
uucugcuccucccaggacguu

SEQ ID NO: 4068 - DNA, 21 bp, Artificial Sequence
  Synthetic polynucleotide
  modified_base (1)..(21): Positions 4, 17 2'-O-methyl ribonucleotide
  modified_base (21)..(21): phosphorothioate linked nucleoside
aagcagaagaggcccccagtt

SEQ ID NO: 4069 - DNA, 21 bp, Artificial Sequence
  Synthetic polynucleotide
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (20)..(21): phosphorothioate linked nucleoside
aagcagaagaggcccccaguu

SEQ ID NO: 4070 - DNA, 21 bp, Artificial Sequence
  Synthetic polynucleotide
  modified_base (1)..(21): Positions 2, 4, 6, 8, 11, 14, 16, 18, 20 2'-deoxy-2'-fluoro ("2'-fluoro") ribonucleotide
  modified_base (1)..(21): Positions 1, 3, 5, 7, 9-10, 12-13, 15, 17, 19, 21 2'-O-methyl ribonucleotide
  modified_base (20)..(21): phosphorothioate linked nucleoside
aagcagaagaggcccccaguu

SEQ ID NO: 4071 - DNA, 21 bp, Artificial Sequence
  Synthetic polynucleotide
  modified_base (1)..(21): Positions 2, 4, 6, 8, 11-12, 14, 16, 18, 20 2'-deoxy-2'-fluoro ("2'-fluoro") ribonucleotide
  modified_base (1)..(21): Positions 1, 3, 5, 7, 9-10, 13, 15, 17, 19, 21 2'-O-methyl ribonucleotide
  modified_base (20)..(21): phosphorothioate linked nucleoside
aagcagaagaggcccccaguu

SEQ ID NO: 4072 - DNA, 21 bp, Artificial Sequence
  Synthetic polynucleotide
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (20)..(21): phosphorothioate linked nucleoside
aagcagaagaggcccccaguu

SEQ ID NO: 4073 - DNA, 21 bp, Artificial Sequence
  Synthetic polynucleotide
  modified_base (1)..(21): Positions 2, 4, 6, 9, 12, 14, 16, 18, 20 2'-deoxy-2'-fluoro ("2'-fluoro") ribonucleotide
  modified_base (1)..(21): Positions 1, 3, 5, 7-8, 10-11, 13, 15, 17, 19, 21 2'-O-methyl ribonucleotide
  modified_base (20)..(21): phosphorothioate linked nucleoside
aagcagaagaggcccccaguu

SEQ ID NO: 4074 - DNA, 21 bp, Artificial Sequence
  Synthetic polynucleotide
  modified_base (1)..(21): Positions 2, 4, 6, 8-9, 12, 14, 16, 18, 20 2'-deoxy-2'-fluoro ("2'-fluoro") ribonucleotide
  modified_base (1)..(21): Positions 1, 3, 5, 7, 10-11, 13, 15, 17, 19, 21 2'-O-methyl ribonucleotide
  modified_base (20)..(21): phosphorothioate linked nucleoside
aagcagaagaggcccccaguu

SEQ ID NO: 4075 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (20)..(21): phosphorothioate linked nucleoside
aagcagaagaggcccccaguu

SEQ ID NO: 4076 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (20)..(21): phosphorothioate linked nucleoside
aagcagaagaggcccccaguu

SEQ ID NO: 4077 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (1)..(21): Positions 2-3, 20-21 phosphorothioate linked nucleoside
aagcagaagaggcccccaguu

SEQ ID NO: 4078 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
aagcagaagaggcccccaguu

SEQ ID NO: 4079 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (1)..(21): Positions 2-3, 20-21 phosphorothioate linked nucleoside
aagcagaagaggcccccaguu

SEQ ID NO: 4080 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
aagcagaagaggcccccaguu

SEQ ID NO: 4081 - DNA, 21 bp, Artificial Sequence
  Synthetic polynucleotide
  modified_base (1)..(21): Positions 2, 4, 6, 8, 10, 12-13, 16, 18, 20 2'-deoxy-2'-fluoro ("2'-fluoro") ribonucleotide
  modified_base (1)..(21): Positions 1, 3, 5, 7, 9, 11, 14-15, 17, 19, 21 2'-O-methyl ribonucleotide
  modified_base (20)..(21): phosphorothioate linked nucleoside
aagcagaagaggcccccaguu

SEQ ID NO: 4082 - DNA, 21 bp, Artificial Sequence
  Synthetic polynucleotide
  modified_base (1)..(21): Positions 2, 4, 6, 8, 10, 12, 15-16, 18, 20 2'-deoxy-2'-fluoro ("2'-fluoro") ribonucleotide
  modified_base (1)..(21): Positions 1, 3, 5, 7, 9, 11, 13-14, 17, 19, 21 2'-O-methyl ribonucleotide
  modified_base (20)..(21): phosphorothioate linked nucleoside
aagcagaagaggcccccaguu

SEQ ID NO: 4083 - DNA, 21 bp, Artificial Sequence
  Synthetic polynucleotide
  modified_base (1)..(21): Positions 2, 4, 6, 8, 10, 12, 14-15, 18, 20 2'-deoxy-2'-fluoro ("2'-fluoro") ribonucleotide
  modified_base (1)..(21): Positions 1, 3, 5, 7, 9, 11, 13, 16-17, 19, 21 2'-O-methyl ribonucleotide
  modified_base (20)..(21): phosphorothioate linked nucleoside
aagcagaagaggcccccaguu

SEQ ID NO: 4084 - DNA, 21 bp, Artificial Sequence
  Synthetic polynucleotide
  modified_base (1)..(21): Positions 2, 4, 6, 8, 10, 12, 14, 17-18, 20 2'-deoxy-2'-fluoro ("2'-fluoro") ribonucleotide
  modified_base (1)..(21): Positions 1, 3, 5, 7, 9, 11, 13, 15-16, 19, 21 2'-O-methyl ribonucleotide
  modified_base (20)..(21): phosphorothioate linked nucleoside
aagcagaagaggcccccaguu

SEQ ID NO: 4085 - DNA, 21 bp, Artificial Sequence
  Synthetic polynucleotide
  modified_base (1)..(21): Positions 2, 4, 6, 8, 10, 12, 14, 16-17, 20 2'-deoxy-2'-fluoro ("2'-fluoro") ribonucleotide
  modified_base (1)..(21): Positions 1, 3, 5, 7, 9, 11, 13, 15, 18-19, 21 2'-O-methyl ribonucleotide
  modified_base (20)..(21): phosphorothioate linked nucleoside
aagcagaagaggcccccaguu

SEQ ID NO: 4086 - DNA, 21 bp, Artificial Sequence
  Synthetic polynucleotide
  modified_base (1)..(21): Positions 2, 4, 6, 8, 10, 12, 14, 16, 19-20 2'-deoxy-2'-fluoro ("2'-fluoro") ribonucleotide
  modified_base (1)..(21): Positions 1, 3, 5, 7, 9, 11, 13, 15, 17-18, 21 2'-O-methyl ribonucleotide
  modified_base (20)..(21): phosphorothioate linked nucleoside
aagcagaagaggcccccaguu

SEQ ID NO: 4087 - DNA, 21 bp, Artificial Sequence
  Synthetic polynucleotide
  modified_base (1)..(21): Positions 2, 4, 6, 8, 10, 12, 14, 16, 18-19 2'-deoxy-2'-fluoro ("2'-fluoro") ribonucleotide
  modified_base (1)..(21): Positions 1, 3, 5, 7, 9, 11, 13, 15, 17, 20-21 2'-O-methyl ribonucleotide
  modified_base (20)..(21): phosphorothioate linked nucleoside
aagcagaagaggcccccaguu

SEQ ID NO: 4088 - DNA, 21 bp, Artificial Sequence
  Synthetic polynucleotide
  modified_base (1)..(21): Positions 2, 4, 7-8, 10, 12, 14, 16, 18, 20 2'-deoxy-2'-fluoro ("2'-fluoro") ribonucleotide
  modified_base (1)..(21): Positions 1, 3, 5-6, 9, 11, 13, 15, 17, 19, 21 2'-O-methyl ribonucleotide
  modified_base (20)..(21): phosphorothioate linked nucleoside
aagcagaagaggcccccaguu

SEQ ID NO: 4089 - DNA, 21 bp, Artificial Sequence
  Synthetic polynucleotide
  modified_base (1)..(21): Positions 2, 4-5, 8, 10, 12, 14, 16, 18, 20 2'-deoxy-2'-fluoro ("2'-fluoro") ribonucleotide
  modified_base (1)..(21): Positions 1, 3, 6-7, 9, 11, 13, 15, 17, 19, 21 2'-O-methyl ribonucleotide
  modified_base (20)..(21): phosphorothioate linked nucleoside
aagcagaagaggcccccaguu

SEQ ID NO: 4090 - DNA, 21 bp, Artificial Sequence
  Synthetic polynucleotide
  modified_base (1)..(21): Positions 2, 5-6, 8, 10, 12, 14, 16, 18, 20 2'-deoxy-2'-fluoro ("2'-fluoro") ribonucleotide
  modified_base (1)..(21): Positions 1, 3-4, 7, 9, 11, 13, 15, 17, 19, 21 2'-O-methyl ribonucleotide
  modified_base (20)..(21): phosphorothioate linked nucleoside
aagcagaagaggcccccaguu

SEQ ID NO: 4091 - DNA, 21 bp, Artificial Sequence
  Synthetic polynucleotide
  modified_base (1)..(21): Positions 2-3, 6, 8, 10, 12, 14, 16, 18, 20 2'-deoxy-2'-fluoro ("2'-fluoro") ribonucleotide
  modified_base (1)..(21): Positions 1, 4-5, 7, 9, 11, 13, 15, 17, 19, 21 2'-O-methyl ribonucleotide
  modified_base (20)..(21): phosphorothioate linked nucleoside
aagcagaagaggcccccaguu

SEQ ID NO: 4092 - DNA, 21 bp, Artificial Sequence
  Synthetic polynucleotide
  modified_base (1)..(21): Positions 3-4, 6, 8, 10, 12, 14, 16, 18, 20 2'-deoxy-2'-fluoro ("2'-fluoro") ribonucleotide
  modified_base (1)..(21): Positions 1-2, 5, 7, 9, 11, 13, 15, 17, 19, 21 2'-O-methyl ribonucleotide
  modified_base (20)..(21): phosphorothioate linked nucleoside
aagcagaagaggcccccaguu

SEQ ID NO: 4093 - DNA, 21 bp, Artificial Sequence
  Synthetic polynucleotide
  modified_base (1)..(21): Positions 1, 4, 6, 8, 10, 12, 14, 16, 18, 20 2'-deoxy-2'-fluoro ("2'-fluoro") ribonucleotide
  modified_base (1)..(21): Positions 2-3, 5, 7, 9, 11, 13, 15, 17, 19, 21 2'-O-methyl ribonucleotide
  modified_base (20)..(21): phosphorothioate linked nucleoside
aagcagaagaggcccccaguu

SEQ ID NO: 4094 - DNA, 21 bp, Artificial Sequence
  Synthetic polynucleotide
  modified_base (1)..(21): Positions 1-2, 4, 6, 8, 10, 12, 14, 16, 18, 20 2'-deoxy-2'-fluoro ("2'-fluoro") ribonucleotide
  modified_base (1)..(21): Positions 3, 5, 7, 9, 11, 13, 15, 17, 19, 21 2'-O-methyl ribonucleotide
  modified_base (20)..(21): phosphorothioate linked nucleoside
aagcagaagaggcccccaguu

SEQ ID NO: 4095 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
  modified_base (20)..(21): phosphorothioate linked nucleoside
aagcagaagaggcccccaguu

SEQ ID NO: 4096 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
  modified_base (20)..(21): phosphorothioate linked nucleoside
aagcagaagaggcccccaguu

SEQ ID NO: 4097 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
  modified_base (20)..(21): phosphorothioate linked nucleoside
aagcagaagaggcccccaguu

SEQ ID NO: 4098 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
  modified_base (20)..(21): phosphorothioate linked nucleoside
aagcagaagaggcccccaguu

SEQ ID NO: 4099 - DNA, 21 bp, Artificial Sequence
  Synthetic polynucleotide
  modified_base (1)..(21): Positions 11, 16 2'-O-methyl ribonucleotide
  modified_base (21)..(21): phosphorothioate linked nucleoside
acuccuuggucaugauaggtt

SEQ ID NO: 4100 - DNA, 21 bp, Artificial Sequence
  Synthetic polynucleotide
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (20)..(21): phosphorothioate linked nucleoside
acuccuuggucaugauagguu

SEQ ID NO: 4101 - DNA, 21 bp, Artificial Sequence
  Synthetic polynucleotide
  modified_base (1)..(21): Positions 2, 4, 6, 8, 11, 14, 16, 18, 20 2'-deoxy-2'-fluoro ("2'-fluoro") ribonucleotide
  modified_base (1)..(21): Positions 1, 3, 5, 7, 9-10, 12-13, 15, 17, 19, 21 2'-O-methyl ribonucleotide
  modified_base (20)..(21): phosphorothioate linked nucleoside
acuccuuggucaugauagguu

SEQ ID NO: 4102 - DNA, 21 bp, Artificial Sequence
  Synthetic polynucleotide
  modified_base (1)..(21): Positions 2, 4, 6, 8, 11-12, 14, 16, 18, 20 2'-deoxy-2'-fluoro ("2'-fluoro") ribonucleotide
  modified_base (1)..(21): Positions 1, 3, 5, 7, 9-10, 13, 15, 17, 19, 21 2'-O-methyl ribonucleotide
  modified_base (20)..(21): phosphorothioate linked nucleoside
acuccuuggucaugauagguu

SEQ ID NO: 4103 - DNA, 21 bp, Artificial Sequence
  Synthetic polynucleotide
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (20)..(21): phosphorothioate linked nucleoside
acuccuuggucaugauagguu

SEQ ID NO: 4104 - DNA, 21 bp, Artificial Sequence
  Synthetic polynucleotide
  modified_base (1)..(21): Positions 2, 4, 6, 9, 12, 14, 16, 18, 20 2'-deoxy-2'-fluoro ("2'-fluoro") ribonucleotide
  modified_base (1)..(21): Positions 1, 3, 5, 7-8, 10-11, 13, 15, 17, 19, 21 2'-O-methyl ribonucleotide
  modified_base (20)..(21): phosphorothioate linked nucleoside
acuccuuggucaugauagguu

SEQ ID NO: 4105 - DNA, 21 bp, Artificial Sequence
  Synthetic polynucleotide
  modified_base (1)..(21): Positions 2, 4, 6, 8-9, 12, 14, 16, 18, 20 2'-deoxy-2'-fluoro ("2'-fluoro") ribonucleotide
  modified_base (1)..(21): Positions 1, 3, 5, 7, 10-11, 13, 15, 17, 19, 21 2'-O-methyl ribonucleotide
  modified_base (20)..(21): phosphorothioate linked nucleoside
acuccuuggucaugauagguu

SEQ ID NO: 4106 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (20)..(21): phosphorothioate linked nucleoside
acuccuuggucaugauagguu

SEQ ID NO: 4107 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (20)..(21): phosphorothioate linked nucleoside
acuccuuggucaugauagguu

SEQ ID NO: 4108 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (1)..(21): Positions 2-3, 20-21 phosphorothioate linked nucleoside
acuccuuggucaugauagguu

SEQ ID NO: 4109 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
acuccuuggucaugauagguu

SEQ ID NO: 4110 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (1)..(21): Positions 2-3, 20-21 phosphorothioate linked nucleoside
acuccuuggucaugauagguu

SEQ ID NO: 4111 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
acuccuuggucaugauagguu

SEQ ID NO: 4112 - DNA, 21 bp, Artificial Sequence
  Synthetic polynucleotide
  modified_base (1)..(21): Positions 2, 4, 6, 8, 10, 12-13, 16, 18, 20 2'-deoxy-2'-fluoro ("2'-fluoro") ribonucleotide
  modified_base (1)..(21): Positions 1, 3, 5, 7, 9, 11, 14-15, 17, 19, 21 2'-O-methyl ribonucleotide
  modified_base (20)..(21): phosphorothioate linked nucleoside
acuccuuggucaugauagguu

SEQ ID NO: 4113 - DNA, 21 bp, Artificial Sequence
  Synthetic polynucleotide
  modified_base (1)..(21): Positions 2, 4, 6, 8, 10, 12, 15-16, 18, 20 2'-deoxy-2'-fluoro ("2'-fluoro") ribonucleotide
  modified_base (1)..(21): Positions 1, 3, 5, 7, 9, 11, 13-14, 17, 19, 21 2'-O-methyl ribonucleotide
  modified_base (20)..(21): phosphorothioate linked nucleoside
acuccuuggucaugauagguu

SEQ ID NO: 4114 - DNA, 21 bp, Artificial Sequence
  Synthetic polynucleotide
  modified_base (1)..(21): Positions 2, 4, 6, 8, 10, 12, 14-15, 18, 20 2'-deoxy-2'-fluoro ("2'-fluoro") ribonucleotide
  modified_base (1)..(21): Positions 1, 3, 5, 7, 9, 11, 13, 16-17, 19, 21 2'-O-methyl ribonucleotide
  modified_base (20)..(21): phosphorothioate linked nucleoside
acuccuuggucaugauagguu

SEQ ID NO: 4115 - DNA, 21 bp, Artificial Sequence
  Synthetic polynucleotide
  modified_base (1)..(21): Positions 2, 4, 6, 8, 10, 12, 14, 17-18, 20 2'-deoxy-2'-fluoro ("2'-fluoro") ribonucleotide
  modified_base (1)..(21): Positions 1, 3, 5, 7, 9, 11, 13, 15-16, 19, 21 2'-O-methyl ribonucleotide
  modified_base (20)..(21): phosphorothioate linked nucleoside
acuccuuggucaugauagguu

SEQ ID NO: 4116 - DNA, 21 bp, Artificial Sequence
  Synthetic polynucleotide
  modified_base (1)..(21): Positions 2, 4, 6, 8, 10, 12, 14, 16-17, 20 2'-deoxy-2'-fluoro ("2'-fluoro") ribonucleotide
  modified_base (1)..(21): Positions 1, 3, 5, 7, 9, 11, 13, 15, 18-19, 21 2'-O-methyl ribonucleotide
  modified_base (20)..(21): phosphorothioate linked nucleoside
acuccuuggucaugauagguu

SEQ ID NO: 4117 - DNA, 21 bp, Artificial Sequence
  Synthetic polynucleotide
  modified_base (1)..(21): Positions 2, 4, 6, 8, 10, 12, 14, 16, 19-20 2'-deoxy-2'-fluoro ("2'-fluoro") ribonucleotide
  modified_base (1)..(21): Positions 1, 3, 5, 7, 9, 11, 13, 15, 17-18, 21 2'-O-methyl ribonucleotide
  modified_base (20)..(21): phosphorothioate linked nucleoside
acuccuuggucaugauagguu

SEQ ID NO: 4118 - DNA, 21 bp, Artificial Sequence
  Synthetic polynucleotide
  modified_base (1)..(21): Positions 2, 4, 6, 8, 10, 12, 14, 16, 18-19 2'-deoxy-2'-fluoro ("2'-fluoro") ribonucleotide
  modified_base (1)..(21): Positions 1, 3, 5, 7, 9, 11, 13, 15, 17, 20-21 2'-O-methyl ribonucleotide
  modified_base (20)..(21): phosphorothioate linked nucleoside
acuccuuggucaugauagguu

SEQ ID NO: 4119 - DNA, 21 bp, Artificial Sequence
  Synthetic polynucleotide
  modified_base (1)..(21): Positions 2, 4, 7-8, 10, 12, 14, 16, 18, 20 2'-deoxy-2'-fluoro ("2'-fluoro") ribonucleotide
  modified_base (1)..(21): Positions 1, 3, 5-6, 9, 11, 13, 15, 17, 19, 21 2'-O-methyl ribonucleotide
  modified_base (20)..(21): phosphorothioate linked nucleoside
acuccuuggucaugauagguu

SEQ ID NO: 4120 - DNA, 21 bp, Artificial Sequence
  Synthetic polynucleotide
  modified_base (1)..(21): Positions 2, 4-5, 8, 10, 12, 14, 16, 18, 20 2'-deoxy-2'-fluoro ("2'-fluoro") ribonucleotide
  modified_base (1)..(21): Positions 1, 3, 6-7, 9, 11, 13, 15, 17, 19, 21 2'-O-methyl ribonucleotide
  modified_base (20)..(21): te linked nucleoside
acuccuuggucaugauagguu

SEQ ID NO: 4121 - DNA, 21 bp, Artificial Sequence
  Synthetic polynucleotide
  modified_base (1)..(21): Positions 2, 5-6, 8, 10, 12, 14, 16, 18, 20 2'-deoxy-2'-fluoro ("2'-fluoro") ribonucleotide
  modified_base (1)..(21): Positions 1, 3-4, 7, 9, 11, 13, 15, 17, 19, 21 2'-O-methyl ribonucleotide
  modified_base (20)..(21): phosphorothioate linked nucleoside
acuccuuggucaugauagguu

SEQ ID NO: 4122 - DNA, 21 bp, Artificial Sequence
  Synthetic polynucleotide
  modified_base (1)..(21): Positions 2-3, 6, 8, 10, 12, 14, 16, 18, 20 2'-deoxy-2'-fluoro ("2'-fluoro") ribonucleotide
  modified_base (1)..(21): Positions 1, 4-5, 7, 9, 11, 13, 15, 17, 19, 21 2'-O-methyl ribonucleotide
  modified_base (20)..(21): phosphorothioate linked nucleoside
acuccuuggucaugauagguu

SEQ ID NO: 4123 - DNA, 21 bp, Artificial Sequence
  Synthetic polynucleotide
  modified_base (1)..(21): Positions 3-4, 6, 8, 10, 12, 14, 16, 18, 20 2'-deoxy-2'-fluoro ("2'-fluoro") ribonucleotide
  modified_base (1)..(21): Positions 1-2, 5, 7, 9, 11, 13, 15, 17, 19, 21 2'-O-methyl ribonucleotide
  modified_base (20)..(21): phosphorothioate linked nucleoside
acuccuuggucaugauagguu

SEQ ID NO: 4124 - DNA, 21 bp, Artificial Sequence
  Synthetic polynucleotide
  modified_base (1)..(21): Positions 1, 4, 6, 8, 10, 12, 14, 16, 18, 20 2'-deoxy-2'-fluoro ("2'-fluoro") ribonucleotide
  modified_base (1)..(21): Positions 2-3, 5, 7, 9, 11, 13, 15, 17, 19, 21 2'-O-methyl ribonucleotide
  modified_base (20)..(21): phosphorothioate linked nucleoside
acuccuuggucaugauagguu

SEQ ID NO: 4125 - DNA, 21 bp, Artificial Sequence
  Synthetic polynucleotide
  modified_base (1)..(21): Positions 1-2, 4, 6, 8, 10, 12, 14, 16, 18, 20 2'-deoxy-2'-fluoro ("2'-fluoro") ribonucleotide
  modified_base (1)..(21): Positions 3, 5, 7, 9, 11, 13, 15, 17, 19, 21 2'-O-methyl ribonucleotide
  modified_base (20)..(21): phosphorothioate linked nucleoside
acuccuuggucaugauagguu

SEQ ID NO: 4126 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
  modified_base (20)..(21): phosphorothioate linked nucleoside
acuccuuggucaugauagguu

SEQ ID NO: 4127 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
  modified_base (20)..(21): phosphorothioate linked nucleoside
acuccuuggucaugauagguu

SEQ ID NO: 4128 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
  modified_base (20)..(21): phosphorothioate linked nucleoside
acuccuuggucaugauagguu

SEQ ID NO: 4129 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
  modified_base (20)..(21): phosphorothioate linked nucleoside
acuccuuggucaugauagguu

SEQ ID NO: 4130 - DNA, 21 bp, Artificial Sequence
  Synthetic polynucleotide
  modified_base (1)..(21): Positions 4, 16, 18 2'-O-methyl ribonucleotide
  modified_base (21)..(21): phosphorothioate linked nucleoside
cuucaucuuucuucccacatt

SEQ ID NO: 4131 - DNA, 21 bp, Artificial Sequence
  Synthetic polynucleotide
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (20)..(21): phosphorothioate linked nucleoside
cuucaucuuucuucccacauu

SEQ ID NO: 4132 - DNA, 21 bp, Artificial Sequence
  Synthetic polynucleotide
  modified_base (1)..(21): Positions 2, 4, 6, 8, 11, 14, 16, 18, 20 2'-deoxy-2'-fluoro ("2'-fluoro") ribonucleotide
  modified_base (1)..(21): Positions 1, 3, 5, 7, 9-10, 12-13, 15, 17, 19, 21 2'-O-methyl ribonucleotide
  modified_base (20)..(21): phosphorothioate linked nucleoside
cuucaucuuucuucccacauu

SEQ ID NO: 4133 - DNA, 21 bp, Artificial Sequence
  Synthetic polynucleotide
  modified_base (1)..(21): Positions 2, 4, 6, 8, 11-12, 14, 16, 18, 20 2'-deoxy-2'-fluoro ("2'-fluoro") ribonucleotide
  modified_base (1)..(21): Positions 1, 3, 5, 7, 9-10, 13, 15, 17, 19, 21 2'-O-methyl ribonucleotide
  modified_base (20)..(21): phosphorothioate linked nucleoside
cuucaucuuucuucccacauu

SEQ ID NO: 4134 - DNA, 21 bp, Artificial Sequence
  Synthetic polynucleotide
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (20)..(21): phosphorothioate linked nucleoside
cuucaucuuucuucccacauu

SEQ ID NO: 4135 - DNA, 21 bp, Artificial Sequence
  Synthetic polynucleotide
  modified_base (1)..(21): Positions 2, 4, 6, 9, 12, 14, 16, 18, 20 2'-deoxy-2'-fluoro ("2'-fluoro") ribonucleotide
  modified_base (1)..(21): Positions 1, 3, 5, 7-8, 10-11, 13, 15, 17, 19, 21 2'-O-methyl ribonucleotide
  modified_base (20)..(21): phosphorothioate linked nucleoside
cuucaucuuucuucccacauu

SEQ ID NO: 4136 - DNA, 21 bp, Artificial Sequence
  Synthetic polynucleotide
  modified_base (1)..(21): Positions 2, 4, 6, 8-9, 12, 14, 16, 18, 20 2'-deoxy-2'-fluoro ("2'-fluoro") ribonucleotide
  modified_base (1)..(21): Positions 1, 3, 5, 7, 10-11, 13, 15, 17, 19, 21 2'-O-methyl ribonucleotide
  modified_base (20)..(21): phosphorothioate linked nucleoside
cuucaucuuucuucccacauu

SEQ ID NO: 4137 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (20)..(21): phosphorothioate linked nucleoside
cuucaucuuucuucccacauu

SEQ ID NO: 4138 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (20)..(21): phosphorothioate linked nucleoside
cuucaucuuucuucccacauu

SEQ ID NO: 4139 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (1)..(21): Positions 2-3, 20-21 phosphorothioate linked nucleoside
cuucaucuuucuucccacauu

SEQ ID NO: 4140 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
cuucaucuuucuucccacauu

SEQ ID NO: 4141 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (1)..(21): Positions 2-3, 20-21 phosphorothioate linked nucleoside
cuucaucuuucuucccacauu

SEQ ID NO: 4142 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
cuucaucuuucuucccacauu

SEQ ID NO: 4143 - DNA, 21 bp, Artificial Sequence
  Synthetic polynucleotide
  modified_base (1)..(21): Positions 2, 4, 6, 8, 10, 12-13, 16, 18, 20 2'-deoxy-2'-fluoro ("2'-fluoro") ribonucleotide
  modified_base (1)..(21): Positions 1, 3, 5, 7, 9, 11, 14-15, 17, 19, 21 2'-O-methyl ribonucleotide
  modified_base (20)..(21): phosphorothioate linked nucleoside
cuucaucuuucuucccacauu

SEQ ID NO: 4144 - DNA, 21 bp, Artificial Sequence
  Synthetic polynucleotide
  modified_base (1)..(21): Positions 2, 4, 6, 8, 10, 12, 15-16, 18, 20 2'-deoxy-2'-fluoro ("2'-fluoro") ribonucleotide
  modified_base (1)..(21): Positions 1, 3, 5, 7, 9, 11, 13-14, 17, 19, 21 2'-O-methyl ribonucleotide
  modified_base (20)..(21): phosphorothioate linked nucleoside
cuucaucuuucuucccacauu

SEQ ID NO: 4145 - DNA, 21 bp, Artificial Sequence
  Synthetic polynucleotide
  modified_base (1)..(21): Positions 2, 4, 6, 8, 10, 12, 14-15, 18, 20 2'-deoxy-2'-fluoro ("2'-fluoro") ribonucleotide
  modified_base (1)..(21): Positions 1, 3, 5, 7, 9, 11, 13, 16-17, 19, 21 2'-O-methyl ribonucleotide
  modified_base (20)..(21): phosphorothioate linked nucleoside
cuucaucuuucuucccacauu

SEQ ID NO: 4146 - DNA, 21 bp, Artificial Sequence
  Synthetic polynucleotide
  modified_base (1)..(21): Positions 2, 4, 6, 8, 10, 12, 14, 17-18, 20 2'-deoxy-2'-fluoro ("2'-fluoro") ribonucleotide
  modified_base (1)..(21): Positions 1, 3, 5, 7, 9, 11, 13, 15-16, 19, 21 2'-O-methyl ribonucleotide
  modified_base (20)..(21): phosphorothioate linked nucleoside
cuucaucuuucuucccacauu

SEQ ID NO: 4147 - DNA, 21 bp, Artificial Sequence
  Synthetic polynucleotide
  modified_base (1)..(21): Positions 2, 4, 6, 8, 10, 12, 14, 16-17, 20 2'-deoxy-2'-fluoro ("2'-fluoro") ribonucleotide
  modified_base (1)..(21): Positions 1, 3, 5, 7, 9, 11, 13, 15, 18-19, 21 2'-O-methyl ribonucleotide
  modified_base (20)..(21): phosphorothioate linked nucleoside
cuucaucuuucuucccacauu

SEQ ID NO: 4148 - DNA, 21 bp, Artificial Sequence
  Synthetic polynucleotide
  modified_base (1)..(21): Positions 2, 4, 6, 8, 10, 12, 14, 16, 19-20 2'-deoxy-2'-fluoro ("2'-fluoro") ribonucleotide
  modified_base (1)..(21): Positions 1, 3, 5, 7, 9, 11, 13, 15, 17-18, 21 2'-O-methyl ribonucleotide
  modified_base (20)..(21): phosphorothioate linked nucleoside
cuucaucuuucuucccacauu

SEQ ID NO: 4149 - DNA, 21 bp, Artificial Sequence
  Synthetic polynucleotide
  modified_base (1)..(21): Positions 2, 4, 6, 8, 10, 12, 14, 16, 18-19 2'-deoxy-2'-fluoro ("2'-fluoro") ribonucleotide
  modified_base (1)..(21): Positions 1, 3, 5, 7, 9, 11, 13, 15, 17, 20-21 2'-O-methyl ribonucleotide
  modified_base (20)..(21): phosphorothioate linked nucleoside
cuucaucuuucuucccacauu

SEQ ID NO: 4150 - DNA, 21 bp, Artificial Sequence
  Synthetic polynucleotide
  modified_base (1)..(21): Positions 2, 4, 7-8, 10, 12, 14, 16, 18, 20 2'-deoxy-2'-fluoro ("2'-fluoro") ribonucleotide
  modified_base (1)..(21): Positions 1, 3, 5-6, 9, 11, 13, 15, 17, 19, 21 2'-O-methyl ribonucleotide
  modified_base (20)..(21): phosphorothioate linked nucleoside
cuucaucuuucuucccacauu

SEQ ID NO: 4151 - DNA, 21 bp, Artificial Sequence
  Synthetic polynucleotide
  modified_base (1)..(21): Positions 2, 4-5, 8, 10, 12, 14, 16, 18, 20 2'-deoxy-2'-fluoro ("2'-fluoro") ribonucleotide
  modified_base (1)..(21): Positions 1, 3, 6-7, 9, 11, 13, 15, 17, 19, 21 2'-O-methyl ribonucleotide
  modified_base (20)..(21): phosphorothioate linked nucleoside
cuucaucuuucuucccacauu

SEQ ID NO: 4152 - DNA, 21 bp, Artificial Sequence
  Synthetic polynucleotide
  modified_base (1)..(21): Positions 2, 5-6, 8, 10, 12, 14, 16, 18, 20 2'-deoxy-2'-fluoro ("2'-fluoro") ribonucleotide
  modified_base (1)..(21): Positions 1, 3-4, 7, 9, 11, 13, 15, 17, 19, 21 2'-O-methyl ribonucleotide
  modified_base (20)..(21): phosphorothioate linked nucleoside
cuucaucuuucuucccacauu

SEQ ID NO: 4153 - DNA, 21 bp, Artificial Sequence
  Synthetic polynucleotide
  modified_base (1)..(21): Positions 2-3, 6, 8, 10, 12, 14, 16, 18, 20 2'-deoxy-2'-fluoro ("2'-fluoro") ribonucleotide
  modified_base (1)..(21): Positions 1, 4-5, 7, 9, 11, 13, 15, 17, 19, 21 2'-O-methyl ribonucleotide
  modified_base (20)..(21): phosphorothioate linked nucleoside
cuucaucuuucuucccacauu

SEQ ID NO: 4154 - DNA, 21 bp, Artificial Sequence
  Synthetic polynucleotide
  modified_base (1)..(21): Positions 3-4, 6, 8, 10, 12, 14, 16, 18, 20 2'-deoxy-2'-fluoro ("2'-fluoro") ribonucleotide
  modified_base (1)..(21): Positions 1-2, 5, 7, 9, 11, 13, 15, 17, 19, 21 2'-O-methyl ribonucleotide
  modified_base (20)..(21): phosphorothioate linked nucleoside
cuucaucuuucuucccacauu

SEQ ID NO: 4155 - DNA, 21 bp, Artificial Sequence
  Synthetic polynucleotide
  modified_base (1)..(21): Positions 1, 4, 6, 8, 10, 12, 14, 16, 18, 20 2'-deoxy-2'-fluoro ("2'-fluoro") ribonucleotide
  modified_base (1)..(21): Positions 2-3, 5, 7, 9, 11, 13, 15, 17, 19, 21 2'-O-methyl ribonucleotide
  modified_base (20)..(21): phosphorothioate linked nucleoside
cuucaucuuucuucccacauu

SEQ ID NO: 4156 - DNA, 21 bp, Artificial Sequence
  Synthetic polynucleotide
  modified_base (1)..(21): Positions 1-2, 4, 6, 8, 10, 12, 14, 16, 18, 20 2'-deoxy-2'-fluoro ("2'-fluoro") ribonucleotide
  modified_base (1)..(21): Positions 3, 5, 7, 9, 11, 13, 15, 17, 19, 21 2'-O-methyl ribonucleotide
  modified_base (20)..(21): phosphorothioate linked nucleoside
cuucaucuuucuucccacauu

SEQ ID NO: 4157 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
  modified_base (20)..(21): phosphorothioate linked nucleoside
cuucaucuuucuucccacauu

SEQ ID NO: 4158 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
  modified_base (20)..(21): phosphorothioate linked nucleoside
cuucaucuuucuucccacauu

SEQ ID NO: 4159 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
  modified_base (20)..(21): phosphorothioate linked nucleoside
cuucaucuuucuucccacauu

SEQ ID NO: 4160 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
  modified_base (20)..(21): phosphorothioate linked nucleoside
cuucaucuuucuucccacauu

SEQ ID NO: 4161 - DNA, 21 bp, Artificial Sequence
  Synthetic polynucleotide
  modified_base (1)..(21): Positions 11, 13 2'-O-methyl ribonucleotide
  modified_base (21)..(21): phosphorothioate linked nucleoside
gugaagugggcacaguccutt

SEQ ID NO: 4162 - DNA, 21 bp, Artificial Sequence
  Synthetic polynucleotide
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (20)..(21): phosphorothioate linked nucleoside
gugaagugggcacaguccuuu

SEQ ID NO: 4163 - DNA, 21 bp, Artificial Sequence
  Synthetic polynucleotide
  modified_base (1)..(21): Positions 2, 4, 6, 8, 11, 14, 16, 18, 20 2'-deoxy-2'-fluoro ("2'-fluoro") ribonucleotide
  modified_base (1)..(21): Positions 1, 3, 5, 7, 9,-10, 12-13, 15, 17, 19, 21 2'-O-methyl ribonucleotide
  modified_base (20)..(21): phosphorothioate linked nucleoside
gugaagugggcacaguccuuu

SEQ ID NO: 4164 - DNA, 21 bp, Artificial Sequence
  Synthetic polynucleotide
  modified_base (1)..(21): Positions 2, 4, 6, 8, 11-12, 14, 16, 18, 20 2'-deoxy-2'-fluoro ("2'-fluoro") ribonucleotide
  modified_base (1)..(21): Positions 1, 3, 5, 7, 9-10, 13, 15, 17, 19, 21 2'-O-methyl ribonucleotide
  modified_base (20)..(21): phosphorothioate linked nucleoside
gugaagugggcacaguccuuu

SEQ ID NO: 4165 - DNA, 21 bp, Artificial Sequence
  Synthetic polynucleotide
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (20)..(21): phosphorothioate linked nucleoside
gugaagugggcacaguccuuu

SEQ ID NO: 4166 - DNA, 21 bp, Artificial Sequence
  Synthetic polynucleotide
  modified_base (1)..(21): Positions 2, 4, 6, 9, 12, 14, 16, 18, 20 2'-deoxy-2'-fluoro ("2'-fluoro") ribonucleotide
  modified_base (1)..(21): Positions 1, 3, 5, 7-8, 10-11, 13, 15, 17, 19, 21 2'-O-methyl ribonucleotide
  modified_base (20)..(21): phosphorothioate linked nucleoside
gugaagugggcacaguccuuu

SEQ ID NO: 4167 - DNA, 21 bp, Artificial Sequence
  Synthetic polynucleotide
  modified_base (1)..(21): Positions 2, 4, 6, 8-9, 12, 14, 16, 18, 20 2'-deoxy-2'-fluoro ("2'-fluoro") ribonucleotide
  modified_base (1)..(21): Positions 1, 3, 5, 7, 10-11, 13, 15, 17, 19, 21 2'-O-methyl ribonucleotide
  modified_base (20)..(21): phosphorothioate linked nucleoside
gugaagugggcacaguccuuu

SEQ ID NO: 4168 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (20)..(21): phosphorothioate linked nucleoside
gugaagugggcacaguccuuu

SEQ ID NO: 4169 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (20)..(21): phosphorothioate linked nucleoside
gugaagugggcacaguccuuu

SEQ ID NO: 4170 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (1)..(21): Positions 2-3, 20-21 phosphorothioate linked nucleoside
gugaagugggcacaguccuuu

SEQ ID NO: 4171 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
gugaagugggcacaguccuuu

SEQ ID NO: 4172 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (1)..(21): Positions 2-3, 20-21 phosphorothioate linked nucleoside
gugaagugggcacaguccuuu

SEQ ID NO: 4173 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
gugaagugggcacaguccuuu

SEQ ID NO: 4174 - DNA, 21 bp, Artificial Sequence
  Synthetic polynucleotide
  modified_base (1)..(21): Positions 2, 4, 6, 8, 10, 12-13, 16, 18, 20 2'-deoxy-2'-fluoro ("2'-fluoro") ribonucleotide
  modified_base (1)..(21): Positions 1, 3, 5, 7, 9, 11, 14-15, 17, 19, 21 2'-O-methyl ribonucleotide
  modified_base (20)..(21): phosphorothioate linked nucleoside
gugaagugggcacaguccuuu

SEQ ID NO: 4175 - DNA, 21 bp, Artificial Sequence
  Synthetic polynucleotide
  modified_base (1)..(21): Positions 2, 4, 6, 8, 10, 12, 15-16, 18, 20 2'-deoxy-2'-fluoro ("2'-fluoro") ribonucleotide
  modified_base (1)..(21): Positions 1, 3, 5, 7, 9, 11, 13-14, 17, 19, 21 2'-O-methyl ribonucleotide
  modified_base (20)..(21): phosphorothioate linked nucleoside
gugaagugggcacaguccuuu

SEQ ID NO: 4176 - DNA, 21 bp, Artificial Sequence
  Synthetic polynucleotide
  modified_base (1)..(21): Positions 2, 4, 6, 8, 10, 12, 14-15, 18, 20 2'-deoxy-2'-fluoro ("2'-fluoro") ribonucleotide
  modified_base (1)..(21): Positions 1, 3, 5, 7, 9, 11, 13, 16-17, 19, 21 2'-O-methyl ribonucleotide
  modified_base (20)..(21): phosphorothioate linked nucleoside
gugaagugggcacaguccuuu

SEQ ID NO: 4177 - DNA, 21 bp, Artificial Sequence
  Synthetic polynucleotide
  modified_base (1)..(21): Positions 2, 4, 6, 8, 10, 12, 14, 17-18, 20 2'-deoxy-2'-fluoro ("2'-fluoro") ribonucleotide
  modified_base (1)..(21): Positions 1, 3, 5, 7, 9, 11, 13, 15-16, 19, 21 2'-O-methyl ribonucleotide
  modified_base (20)..(21): phosphorothioate linked nucleoside
gugaagugggcacaguccuuu

SEQ ID NO: 4178 - DNA, 21 bp, Artificial Sequence
  Synthetic polynucleotide
  modified_base (1)..(21): Positions 2, 4, 6, 8, 10, 12, 14, 16-17, 20 2'-deoxy-2'-fluoro ("2'-fluoro") ribonucleotide
  modified_base (1)..(21): Positions 1, 3, 5, 7, 9, 11, 13, 15, 18-19, 21 2'-O-methyl ribonucleotide
  modified_base (20)..(21): phosphorothioate linked nucleoside
gugaagugggcacaguccuuu

SEQ ID NO: 4179 - DNA, 21 bp, Artificial Sequence
  Synthetic polynucleotide
  modified_base (1)..(21): Positions 2, 4, 6, 8, 10, 12, 14, 16, 19-20 2'-deoxy-2'-fluoro ("2'-fluoro") ribonucleotide
  modified_base (1)..(21): Positions 1, 3, 5, 7, 9, 11, 13, 15, 17-18, 21 2'-O-methyl ribonucleotide
  modified_base (20)..(21): phosphorothioate linked nucleoside
gugaagugggcacaguccuuu

SEQ ID NO: 4180 - DNA, 21 bp, Artificial Sequence
  Synthetic polynucleotide
  modified_base (1)..(21): Positions 2, 4, 6, 8, 10, 12, 14, 16, 18-19 2'-deoxy-2'-fluoro ("2'-fluoro") ribonucleotide
  modified_base (1)..(21): Positions 1, 3, 5, 7, 9, 11, 13, 15, 17, 20-21 2'-O-methyl ribonucleotide
  modified_base (20)..(21): phosphorothioate linked nucleoside
gugaagugggcacaguccuuu

SEQ ID NO: 4181 - DNA, 21 bp, Artificial Sequence
  Synthetic polynucleotide
  modified_base (1)..(21): Positions 2, 4, 7-8, 10, 12, 14, 16, 18, 20 2'-deoxy-2'-fluoro ("2'-fluoro") ribonucleotide
  modified_base (1)..(21): Positions 1, 3, 5-6, 9, 11, 13, 15, 17, 19, 21 2'-O-methyl ribonucleotide
  modified_base (20)..(21): phosphorothioate linked nucleoside
gugaagugggcacaguccuuu

SEQ ID NO: 4182 - DNA, 21 bp, Artificial Sequence
  Synthetic polynucleotide
  modified_base (1)..(21): Positions 2, 4-5, 8, 10, 12, 14, 16, 18, 20 2'-deoxy-2'-fluoro ("2'-fluoro") ribonucleotide
  modified_base (1)..(21): Positions 1, 3, 6-7, 9, 11, 13, 15, 17, 19, 21 2'-O-methyl ribonucleotide
  modified_base (20)..(21): phosphorothioate linked nucleoside
gugaagugggcacaguccuuu

SEQ ID NO: 4183 - DNA, 21 bp, Artificial Sequence
  Synthetic polynucleotide
  modified_base (1)..(21): Positions 2, 5-6, 8, 10, 12, 14, 16, 18, 20 2'-deoxy-2'-fluoro ("2'-fluoro") ribonucleotide
  modified_base (1)..(21): Positions 1, 3-4, 7, 9, 11, 13, 15, 17, 19, 21 2'-O-methyl ribonucleotide
  modified_base (20)..(21): phosphorothioate linked nucleoside
gugaagugggcacaguccuuu

SEQ ID NO: 4184 - DNA, 21 bp, Artificial Sequence
  Synthetic polynucleotide
  modified_base (1)..(21): Positions 2-3, 6, 8, 10, 12, 14, 16, 18, 20 2'-deoxy-2'-fluoro ("2'-fluoro") ribonucleotide
  modified_base (1)..(21): Positions 1, 4-5, 7, 9, 11, 13, 15, 17, 19, 21 2'-O-methyl ribonucleotide
  modified_base (20)..(21): phosphorothioate linked nucleoside
gugaagugggcacaguccuuu

SEQ ID NO: 4185 - DNA, 21 bp, Artificial Sequence
  Synthetic polynucleotide
  modified_base (1)..(21): Positions 3-4, 6, 8, 10, 12, 14, 16, 18, 20 2'-deoxy-2'-fluoro ("2'-fluoro") ribonucleotide
  modified_base (1)..(21): Positions 1-2, 5, 7, 9, 11, 13, 15, 17, 19, 21 2'-O-methyl ribonucleotide
  modified_base (20)..(21): phosphorothioate linked nucleoside
gugaagugggcacaguccuuu

SEQ ID NO: 4186 - DNA, 21 bp, Artificial Sequence
  Synthetic polynucleotide
  modified_base (1)..(21): Positions 1, 4, 6, 8, 10, 12, 14, 16, 18, 20 2'-deoxy-2'-fluoro ("2'-fluoro") ribonucleotide
  modified_base (1)..(21): Positions 2-3, 5, 7, 9, 11, 13, 15, 17, 19, 21 2'-O-methyl ribonucleotide
  modified_base (20)..(21): phosphorothioate linked nucleoside
gugaagugggcacaguccuuu

SEQ ID NO: 4187 - DNA, 21 bp, Artificial Sequence
  Synthetic polynucleotide
  modified_base (1)..(21): Positions 1-2, 4, 6, 8, 10, 12, 14, 16, 18, 20 2'-deoxy-2'-fluoro ("2'-fluoro") ribonucleotide
  modified_base (1)..(21): Positions 3, 5, 7, 9, 11, 13, 15, 17, 19, 21 2'-O-methyl ribonucleotide
  modified_base (20)..(21): phosphorothioate linked nucleoside
gugaagugggcacaguccuuu

SEQ ID NO: 4188 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
  modified_base (20)..(21): phosphorothioate linked nucleoside
gugaagugggcacaguccuuu

SEQ ID NO: 4189 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
  modified_base (20)..(21): phosphorothioate linked nucleoside
gugaagugggcacaguccuuu

SEQ ID NO: 4190 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
  modified_base (20)..(21): phosphorothioate linked nucleoside
gugaagugggcacaguccuuu

SEQ ID NO: 4191 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
  modified_base (20)..(21): phosphorothioate linked nucleoside
gugaagugggcacaguccuuu

SEQ ID NO: 4192 - DNA, 21 bp, Artificial Sequence
  Synthetic polynucleotide
  modified_base (1)..(21): Positions 8, 11, 16 2'-O-methyl ribonucleotide
  modified_base (21)..(21): phosphorothioate linked nucleoside
uucggaacaucacccuauctt

SEQ ID NO: 4193 - DNA, 21 bp, Artificial Sequence
  Synthetic polynucleotide
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (20)..(21): phosphorothioate linked nucleoside
uucggaacaucacccuaucuu

SEQ ID NO: 4194 - DNA, 21 bp, Artificial Sequence
  Synthetic polynucleotide
  modified_base (1)..(21): Positions 2, 4, 6, 8, 11, 14, 16, 18, 20 2'-deoxy-2'-fluoro ("2'-fluoro") ribonucleotide
  modified_base (1)..(21): Positions 1, 3, 5, 7, 9-10, 12-13, 15, 17, 19, 21 2'-O-methyl ribonucleotide
  modified_base (20)..(21): phosphorothioate linked nucleoside
uucggaacaucacccuaucuu

SEQ ID NO: 4195 - DNA, 21 bp, Artificial Sequence
  Synthetic polynucleotide
  modified_base (1)..(21): Positions 2, 4, 6, 8, 11-12, 14, 16, 18, 20 2'-deoxy-2'-fluoro ("2'-fluoro") ribonucleotide
  modified_base (1)..(21): Positions 1, 3, 5, 7, 9-10, 13, 15, 17, 19, 21 2'-O-methyl ribonucleotide
  modified_base (20)..(21): phosphorothioate linked nucleoside
uucggaacaucacccuaucuu

SEQ ID NO: 4196 - DNA, 21 bp, Artificial Sequence
  Synthetic polynucleotide
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (20)..(21): phosphorothioate linked nucleoside
uucggaacaucacccuaucuu

SEQ ID NO: 4197 - DNA, 21 bp, Artificial Sequence
  Synthetic polynucleotide
  modified_base (1)..(21): Positions 2, 4, 6, 9, 12, 14, 16, 18, 20 2'-deoxy-2'-fluoro ("2'-fluoro") ribonucleotide
  modified_base (1)..(21): Positions 1, 3, 5, 7-8, 10-11, 13, 15, 17, 19, 21 2'-O-methyl ribonucleotide
  modified_base (20)..(21): phosphorothioate linked nucleoside
uucggaacaucacccuaucuu

SEQ ID NO: 4198 - DNA, 21 bp, Artificial Sequence
  Synthetic polynucleotide
  modified_base (1)..(21): Positions 2, 4, 6, 8-9, 12, 14, 16, 18, 20 2'-deoxy-2'-fluoro ("2'-fluoro") ribonucleotide
  modified_base (1)..(21): Positions 1, 3, 5, 7, 10-11, 13, 15, 17, 19, 21 2'-O-methyl ribonucleotide
  modified_base (20)..(21): phosphorothioate linked nucleoside
uucggaacaucacccuaucuu

SEQ ID NO: 4199 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (20)..(21): phosphorothioate linked nucleoside
uucggaacaucacccuaucuu

SEQ ID NO: 4200 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (20)..(21): phosphorothioate linked nucleoside
uucggaacaucacccuaucuu

SEQ ID NO: 4201 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (1)..(21): Positions 2-3, 20-21 phosphorothioate linked nucleoside
uucggaacaucacccuaucuu

SEQ ID NO: 4202 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
uucggaacaucacccuaucuu

SEQ ID NO: 4203 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (1)..(21): Positions 2-3, 20-21 phosphorothioate linked nucleoside
uucggaacaucacccuaucuu

SEQ ID NO: 4204 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
uucggaacaucacccuaucuu

SEQ ID NO: 4205 - DNA, 21 bp, Artificial Sequence
  Synthetic polynucleotide
  modified_base (1)..(21): Positions 2, 4, 6, 8, 10, 12-13, 16, 18, 20 2'-deoxy-2'-fluoro ("2'-fluoro") ribonucleotide
  modified_base (1)..(21): Positions 1, 3, 5, 7, 9, 11, 14-15, 17, 19, 21 2'-O-methyl ribonucleotide
  modified_base (20)..(21): phosphorothioate linked nucleoside
uucggaacaucacccuaucuu

SEQ ID NO: 4206 - DNA, 21 bp, Artificial Sequence
  Synthetic polynucleotide
  modified_base (1)..(21): Positions 2, 4, 6, 8, 10, 12, 15-16, 18, 20 2'-deoxy-2'-fluoro ("2'-fluoro") ribonucleotide
  modified_base (1)..(21): Positions 1, 3, 5, 7, 9, 11, 13-14, 17, 19, 21 2'-O-methyl ribonucleotide
  modified_base (20)..(21): phosphorothioate linked nucleoside
uucggaacaucacccuaucuu

SEQ ID NO: 4207 - DNA, 21 bp, Artificial Sequence
  Synthetic polynucleotide
  modified_base (1)..(21): Positions 2, 4, 6, 8, 10, 12, 14-15, 18, 20 2'-deoxy-2'-fluoro ("2'-fluoro") ribonucleotide
  modified_base (1)..(21): Positions 1, 3, 5, 7, 9, 11, 13, 16-17, 19, 21 2'-O-methyl ribonucleotide
  modified_base (20)..(21): phosphorothioate linked nucleoside
uucggaacaucacccuaucuu

SEQ ID NO: 4208 - DNA, 21 bp, Artificial Sequence
  Synthetic polynucleotide
  modified_base (1)..(21): Positions 2, 4, 6, 8, 10, 12, 14, 17-18, 20 2'-deoxy-2'-fluoro ("2'-fluoro") ribonucleotide
  modified_base (1)..(21): Positions 1, 3, 5, 7, 9, 11, 13, 15-16, 19, 21 2'-O-methyl ribonucleotide
  modified_base (20)..(21): phosphorothioate linked nucleoside
uucggaacaucacccuaucuu

SEQ ID NO: 4209 - DNA, 21 bp, Artificial Sequence
  Synthetic polynucleotide
  modified_base (1)..(21): Positions 2, 4, 6, 8, 10, 12, 14, 16-17, 20 2'-deoxy-2'-fluoro ("2'-fluoro") ribonucleotide
  modified_base (1)..(21): Positions 1, 3, 5, 7, 9, 11, 13, 15, 18-19, 21 2'-O-methyl ribonucleotide
  modified_base (20)..(21): phosphorothioate linked nucleoside
uucggaacaucacccuaucuu

SEQ ID NO: 4210 - DNA, 21 bp, Artificial Sequence
  Synthetic polynucleotide
  modified_base (1)..(21): Positions 2, 4, 6, 8, 10, 12, 14, 16, 19-20 2'-deoxy-2'-fluoro ("2'-fluoro") ribonucleotide
  modified_base (1)..(21): Positions 1, 3, 5, 7, 9, 11, 13, 15, 17-18, 21 2'-O-methyl ribonucleotide
  modified_base (20)..(21): phosphorothioate linked nucleoside
uucggaacaucacccuaucuu

SEQ ID NO: 4211 - DNA, 21 bp, Artificial Sequence
  Synthetic polynucleotide
  modified_base (1)..(21): Positions 2, 4, 6, 8, 10, 12, 14, 16, 18-19 2'-deoxy-2'-fluoro ("2'-fluoro") ribonucleotide
  modified_base (1)..(21): Positions 1, 3, 5, 7, 9, 11, 13, 15, 17, 20-21 2'-O-methyl ribonucleotide
  modified_base (20)..(21): phosphorothioate linked nucleoside
uucggaacaucacccuaucuu

SEQ ID NO: 4212 - DNA, 21 bp, Artificial Sequence
  Synthetic polynucleotide
  modified_base (1)..(21): Positions 2, 4, 7-8, 10, 12, 14, 16, 18, 20 2'-deoxy-2'-fluoro ("2'-fluoro") ribonucleotide
  modified_base (1)..(21): Positions 1, 3, 5-6, 9, 11, 13, 15, 17, 19, 21 2'-O-methyl ribonucleotide
  modified_base (20)..(21): phosphorothioate linked nucleoside
uucggaacaucacccuaucuu

SEQ ID NO: 4213 - DNA, 21 bp, Artificial Sequence
  Synthetic polynucleotide
  modified_base (1)..(21): Positions 2, 4-5, 8, 10, 12, 14, 16, 18, 20 2'-deoxy-2'-fluoro ("2'-fluoro") ribonucleotide
  modified_base (1)..(21): Positions 1, 3, 6-7, 9, 11, 13, 15, 17, 19, 21 2'-O-methyl ribonucleotide
  modified_base (20)..(21): phosphorothioate linked nucleoside
uucggaacaucacccuaucuu

SEQ ID NO: 4214 - DNA, 21 bp, Artificial Sequence
  Synthetic polynucleotide
  modified_base (1)..(21): Positions 2, 5-6, 8, 10, 12, 14, 16, 18, 20 2'-deoxy-2'-fluoro ("2'-fluoro") ribonucleotide
  modified_base (1)..(21): Positions 1, 3-4, 7, 9, 11, 13, 15, 17, 19, 21 2'-O-methyl ribonucleotide
  modified_base (20)..(21): phosphorothioate linked nucleoside
uucggaacaucacccuaucuu

SEQ ID NO: 4215 - DNA, 21 bp, Artificial Sequence
  Synthetic polynucleotide
  modified_base (1)..(21): Positions 2-3, 6, 8, 10, 12, 14, 16, 18, 20 2'-deoxy-2'-fluoro ("2'-fluoro") ribonucleotide
  modified_base (1)..(21): Positions 1, 4-5, 7, 9, 11, 13, 15, 17, 19, 21 2'-O-methyl ribonucleotide
  modified_base (20)..(21): phosphorothioate linked nucleoside
uucggaacaucacccuaucuu

SEQ ID NO: 4216 - DNA, 21 bp, Artificial Sequence
  Synthetic polynucleotide
  modified_base (1)..(21): Positions 3-4, 6, 8, 10, 12, 14, 16, 18, 20 2'-deoxy-2'-fluoro ("2'-fluoro") ribonucleotide
  modified_base (1)..(21): Positions 1-2, 5, 7, 9, 11, 13, 15, 17, 19, 21 2'-O-methyl ribonucleotide
  modified_base (20)..(21): phosphorothioate linked nucleoside
uucggaacaucacccuaucuu

SEQ ID NO: 4217 - DNA, 21 bp, Artificial Sequence
  Synthetic polynucleotide
  modified_base (1)..(21): Positions 1, 4, 6, 8, 10, 12, 14, 16, 18, 20 2'-deoxy-2'-fluoro ("2'-fluoro") ribonucleotide
  modified_base (1)..(21): Positions 2-3, 5, 7, 9, 11, 13, 15, 17, 19, 21 2'-O-methyl ribonucleotide
  modified_base (20)..(21): phosphorothioate linked nucleoside
uucggaacaucacccuaucuu

SEQ ID NO: 4218 - DNA, 21 bp, Artificial Sequence
  Synthetic polynucleotide
  modified_base (1)..(21): Positions 1-2, 4, 6, 8, 10, 12, 14, 16, 18, 20 2'-deoxy-2'-fluoro ("2'-fluoro") ribonucleotide
  modified_base (1)..(21): Positions 3, 5, 7, 9, 11, 13, 15, 17, 19, 21 2'-O-methyl ribonucleotide
  modified_base (20)..(21): phosphorothioate linked nucleoside
uucggaacaucacccuaucuu

SEQ ID NO: 4219 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
  modified_base (20)..(21): phosphorothioate linked nucleoside
uucggaacaucacccuaucuu

SEQ ID NO: 4220 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
  modified_base (20)..(21): phosphorothioate linked nucleoside
uucggaacaucacccuaucuu

SEQ ID NO: 4221 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
  modified_base (20)..(21): phosphorothioate linked nucleoside
uucggaacaucacccuaucuu

SEQ ID NO: 4222 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
  modified_base (20)..(21): phosphorothioate linked nucleoside
uucggaacaucacccuaucuu

SEQ ID NO: 4223 - DNA, 21 bp, Artificial Sequence
  Synthetic polynucleotide
  modified_base (1)..(21): Positions 5, 12 2'-O-methyl ribonucleotide
  modified_base (21)..(21): phosphorothioate linked nucleoside
augauaaccugcaaacugctt

SEQ ID NO: 4224 - DNA, 21 bp, Artificial Sequence
  Synthetic polynucleotide
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (20)..(21): phosphorothioate linked nucleoside
augauaaccugcaaacugcuu

SEQ ID NO: 4225 - DNA, 21 bp, Artificial Sequence
  Synthetic polynucleotide
  modified_base (1)..(21): Positions 2, 4, 6, 8, 11, 14, 16, 18, 20 2'-deoxy-2'-fluoro ("2'-fluoro") ribonucleotide
  modified_base (1)..(21): Positions 1, 3, 5, 7, 9-10, 12-13, 15, 17, 19, 21 2'-O-methyl ribonucleotide
  modified_base (20)..(21): phosphorothioate linked nucleoside
augauaaccugcaaacugcuu

SEQ ID NO: 4226 - DNA, 21 bp, Artificial Sequence
  Synthetic polynucleotide
  modified_base (1)..(21): Positions 2, 4, 6, 8, 11-12, 14, 16, 18, 20 2'-deoxy-2'-fluoro ("2'-fluoro") ribonucleotide
  modified_base (1)..(21): Positions 1, 3, 5, 7, 9-10, 13, 15, 17, 19, 21 2'-O-methyl ribonucleotide
  modified_base (20)..(21): phosphorothioate linked nucleoside
augauaaccugcaaacugcuu

SEQ ID NO: 4227 - DNA, 21 bp, Artificial Sequence
  Synthetic polynucleotide
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (20)..(21): phosphorothioate linked nucleoside
augauaaccugcaaacugcuu

SEQ ID NO: 4228 - DNA, 21 bp, Artificial Sequence
  Synthetic polynucleotide
  modified_base (1)..(21): Positions 2, 4, 6, 9, 12, 14, 16, 18, 20 2'-deoxy-2'-fluoro ("2'-fluoro") ribonucleotide
  modified_base (1)..(21): Positions 1, 3, 5, 7-8, 10-11, 13, 15, 17, 19, 21 2'-O-methyl ribonucleotide
  modified_base (20)..(21): phosphorothioate linked nucleoside
augauaaccugcaaacugcuu

SEQ ID NO: 4229 - DNA, 21 bp, Artificial Sequence
  Synthetic polynucleotide
  modified_base (1)..(21): Positions 2, 4, 6, 8-9, 12, 14, 16, 18, 20 2'-deoxy-2'-fluoro ("2'-fluoro") ribonucleotide
  modified_base (1)..(21): Positions 1, 3, 5, 7, 10-11, 13, 15, 17, 19, 21 2'-O-methyl ribonucleotide
  modified_base (20)..(21): phosphorothioate linked nucleoside
augauaaccugcaaacugcuu

SEQ ID NO: 4230 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (20)..(21): phosphorothioate linked nucleoside
augauaaccugcaaacugcuu

SEQ ID NO: 4231 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (20)..(21): phosphorothioate linked nucleoside
augauaaccugcaaacugcuu

SEQ ID NO: 4232 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (1)..(21): Positions 2-3, 20-21 phosphorothioate linked nucleoside
augauaaccugcaaacugcuu

SEQ ID NO: 4233 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
augauaaccugcaaacugcuu

SEQ ID NO: 4234 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (1)..(21): Positions 2-3, 20-21 phosphorothioate linked nucleoside
augauaaccugcaaacugcuu

SEQ ID NO: 4235 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
augauaaccugcaaacugcuu

SEQ ID NO: 4236 - DNA, 21 bp, Artificial Sequence
  Synthetic polynucleotide
  modified_base (1)..(21): Positions 2, 4, 6, 8, 10, 12-13, 16, 18, 20 2'-deoxy-2'-fluoro ("2'-fluoro") ribonucleotide
  modified_base (1)..(21): Positions 1, 3, 5, 7, 9, 11, 14-15, 17, 19, 21 2'-O-methyl ribonucleotide
  modified_base (20)..(21): phosphorothioate linked nucleoside
augauaaccugcaaacugcuu

SEQ ID NO: 4237 - DNA, 21 bp, Artificial Sequence
  Synthetic polynucleotide
  modified_base (1)..(21): Positions 2, 4, 6, 8, 10, 12, 15-16, 18, 20 2'-deoxy-2'-fluoro ("2'-fluoro") ribonucleotide
  modified_base (1)..(21): Positions 1, 3, 5, 7, 9, 11, 13-14, 17, 19, 21 2'-O-methyl ribonucleotide
  modified_base (20)..(21): phosphorothioate linked nucleoside
augauaaccugcaaacugcuu

SEQ ID NO: 4238 - DNA, 21 bp, Artificial Sequence
  Synthetic polynucleotide
  modified_base (1)..(21): Positions 2, 4, 6, 8, 10, 12, 14-15, 18, 20 2'-deoxy-2'-fluoro ("2'-fluoro") ribonucleotide
  modified_base (1)..(21): Positions 1, 3, 5, 7, 9, 11, 13, 15, 18-19, 21 2'-O-methyl ribonucleotide
  modified_base (20)..(21): phosphorothioate linked nucleoside
augauaaccugcaaacugcuu

SEQ ID NO: 4239 - DNA, 21 bp, Artificial Sequence
  Synthetic polynucleotide
  modified_base (1)..(21): Positions 2, 4, 6, 8, 10, 12, 14, 17-18, 20 2'-deoxy-2'-fluoro ("2'-fluoro") ribonucleotide
  modified_base (1)..(21): Positions 1, 3, 5, 7, 9, 11, 13, 15-16, 19, 21 2'-O-methyl ribonucleotide
  modified_base (20)..(21): phosphorothioate linked nucleoside
augauaaccugcaaacugcuu

SEQ ID NO: 4240 - DNA, 21 bp, Artificial Sequence
  Synthetic polynucleotide
  modified_base (1)..(21): Positions 2, 4, 6, 8, 10, 12, 14, 16-17, 20 2'-deoxy-2'-fluoro ("2'-fluoro") ribonucleotide
  modified_base (1)..(21): Positions 1, 3, 5, 7, 9, 11, 13, 15, 18-19, 21 2'-O-methyl ribonucleotide
  modified_base (20)..(21): phosphorothioate linked nucleoside
augauaaccugcaaacugcuu

SEQ ID NO: 4241 - DNA, 21 bp, Artificial Sequence
  Synthetic polynucleotide
  modified_base (1)..(21): Positions 2, 4, 6, 8, 10, 12, 14, 16, 19-20 2'-deoxy-2'-fluoro ("2'-fluoro") ribonucleotide
  modified_base (1)..(21): Positions 1, 3, 5, 7, 9, 11, 13, 15, 17-18, 21 2'-O-methyl ribonucleotide
  modified_base (20)..(21): phosphorothioate linked nucleoside
augauaaccugcaaacugcuu

SEQ ID NO: 4242 - DNA, 21 bp, Artificial Sequence
  Synthetic polynucleotide
  modified_base (1)..(21): Positions 2, 4, 6, 8, 10, 12, 14, 16, 18-19 2'-deoxy-2'-fluoro ("2'-fluoro") ribonucleotide
  modified_base (1)..(21): Positions 1, 3, 5, 7, 9, 11, 13, 15, 17, 20-21 2'-O-methyl ribonucleotide
  modified_base (20)..(21): phosphorothioate linked nucleoside
augauaaccugcaaacugcuu

SEQ ID NO: 4243 - DNA, 21 bp, Artificial Sequence
  Synthetic polynucleotide
  modified_base (1)..(21): Positions 2, 4, 7-8, 10, 12, 14, 16, 18, 20 2'-deoxy-2'-fluoro ("2'-fluoro") ribonucleotide
  modified_base (1)..(21): Positions 1, 3, 5-6, 9, 11, 13, 15, 17, 19, 21 2'-O-methyl ribonucleotide
  modified_base (20)..(21): phosphorothioate linked nucleoside
augauaaccugcaaacugcuu

SEQ ID NO: 4244 - DNA, 21 bp, Artificial Sequence
  Synthetic polynucleotide
  modified_base (1)..(21): Positions 2, 4-5, 8, 10, 12, 14, 16, 18, 20 2'-deoxy-2'-fluoro ("2'-fluoro") ribonucleotide
  modified_base (1)..(21): Positions 1, 3, 6-7, 9, 11, 13, 15, 17, 19, 21 2'-O-methyl ribonucleotide
  modified_base (20)..(21): phosphorothioate linked nucleoside
augauaaccugcaaacugcuu

SEQ ID NO: 4245 - DNA, 21 bp, Artificial Sequence
  Synthetic polynucleotide
  modified_base (1)..(21): Positions 2, 5-6, 8, 10, 12, 14, 16, 18, 20 2'-deoxy-2'-fluoro ("2'-fluoro") ribonucleotide
  modified_base (1)..(21): Positions 1, 3-4, 7, 9, 11, 13, 15, 17, 19, 21 2'-O-methyl ribonucleotide
  modified_base (20)..(21): phosphorothioate linked nucleoside
augauaaccugcaaacugcuu

SEQ ID NO: 4246 - DNA, 21 bp, Artificial Sequence
  Synthetic polynucleotide
  modified_base (1)..(21): Positions 2-3, 6, 8, 10, 12, 14, 16, 18, 20 2'-deoxy-2'-fluoro ("2'-fluoro") ribonucleotide
  modified_base (1)..(21): Positions 1, 4-5, 7, 9, 11, 13, 15, 17, 19, 21 2'-O-methyl ribonucleotide
  modified_base (20)..(21): phosphorothioate linked nucleoside
augauaaccugcaaacugcuu

SEQ ID NO: 4247 - DNA, 21 bp, Artificial Sequence
  Synthetic polynucleotide
  modified_base (1)..(21): Positions 3-4, 6, 8, 10, 12, 14, 16, 18, 20 2'-deoxy-2'-fluoro ("2'-fluoro") ribonucleotide
  modified_base (1)..(21): Positions 1-2, 5, 7, 9, 11, 13, 15, 17, 19, 21 2'-O-methyl ribonucleotide
  modified_base (20)..(21): phosphorothioate linked nucleoside
augauaaccugcaaacugcuu

SEQ ID NO: 4248 - DNA, 21 bp, Artificial Sequence
  Synthetic polynucleotide
  modified_base (1)..(21): Positions 1, 4, 6, 8, 10, 12, 14, 16, 18, 20 2'-deoxy-2'-fluoro ("2'-fluoro") ribonucleotide
  modified_base (1)..(21): Positions 2-3, 5, 7, 9, 11, 13, 15, 17, 19, 21 2'-O-methyl ribonucleotide
  modified_base (20)..(21): phosphorothioate linked nucleoside
augauaaccugcaaacugcuu

SEQ ID NO: 4249 - DNA, 21 bp, Artificial Sequence
  Synthetic polynucleotide
  modified_base (1)..(21): Positions 1-2, 4, 6, 8, 10, 12, 14, 16, 18, 20 2'-deoxy-2'-fluoro ("2'-fluoro") ribonucleotide
  modified_base (1)..(21): Positions 3, 5, 7, 9, 11, 13, 15, 17, 19, 21 2'-O-methyl ribonucleotide
  modified_base (20)..(21): phosphorothioate linked nucleoside
augauaaccugcaaacugcuu

SEQ ID NO: 4250 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
  modified_base (20)..(21): phosphorothioate linked nucleoside
augauaaccugcaaacugcuu

SEQ ID NO: 4251 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
  modified_base (20)..(21): phosphorothioate linked nucleoside
augauaaccugcaaacugcuu

SEQ ID NO: 4252 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
  modified_base (20)..(21): phosphorothioate linked nucleoside
augauaaccugcaaacugcuu

SEQ ID NO: 4253 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
  modified_base (20)..(21): phosphorothioate linked nucleoside
augauaaccugcaaacugcuu

SEQ ID NO: 4254 - DNA, 21 bp, Artificial Sequence
  Synthetic polynucleotide
  modified_base (1)..(21): Positions 7, 9, 11, 15 2'-O-methyl ribonucleotide
  modified_base (21)..(21): phosphorothioate linked nucleoside
uccgaucacacagacaacctt

SEQ ID NO: 4255 - DNA, 21 bp, Artificial Sequence
  Synthetic polynucleotide
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (20)..(21): phosphorothioate linked nucleoside
uccgaucacacagacaaccuu

SEQ ID NO: 4256 - DNA, 21 bp, Artificial Sequence
  Synthetic polynucleotide
  modified_base (1)..(21): Positions 2, 4, 6, 8, 11, 14, 16, 18, 20 2'-deoxy-2'-fluoro ("2'-fluoro") ribonucleotide
  modified_base (1)..(21): Positions 1, 3, 5, 7, 9-10, 12-13, 15, 17, 19, 21 2'-O-methyl ribonucleotide
  modified_base (20)..(21): phosphorothioate linked nucleoside
uccgaucacacagacaaccuu

SEQ ID NO: 4257 - DNA, 21 bp, Artificial Sequence
  Synthetic polynucleotide
  modified_base (1)..(21): Positions 2, 4, 6, 8, 11-12, 14, 16, 18, 20 2'-deoxy-2'-fluoro ("2'-fluoro") ribonucleotide
  modified_base (1)..(21): Positions 1, 3, 5, 7, 9-10, 13, 15, 17, 19, 21 2'-O-methyl ribonucleotide
  modified_base (20)..(21): phosphorothioate linked nucleoside
uccgaucacacagacaaccuu

SEQ ID NO: 4258 - DNA, 21 bp, Artificial Sequence
  Synthetic polynucleotide
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (20)..(21): phosphorothioate linked nucleoside
uccgaucacacagacaaccuu

SEQ ID NO: 4259 - DNA, 21 bp, Artificial Sequence
  Synthetic polynucleotide
  modified_base (1)..(21): Positions 2, 4, 6, 9, 12, 14, 16, 18, 20 2'-deoxy-2'-fluoro ("2'-fluoro") ribonucleotide
  modified_base (1)..(21): Positions 1, 3, 5, 7-8, 10-11, 13, 15, 17, 19, 21 2'-O-methyl ribonucleotide
  modified_base (20)..(21): phosphorothioate linked nucleoside
uccgaucacacagacaaccuu

SEQ ID NO: 4260 - DNA, 21 bp, Artificial Sequence
  Synthetic polynucleotide
  modified_base (1)..(21): Positions 2, 4, 6, 8-9, 12, 14, 16, 18, 20 2'-deoxy-2'-fluoro ("2'-fluoro") ribonucleotide
  modified_base (1)..(21): Positions 1, 3, 5, 7, 10-11, 13, 15, 17, 19, 21 2'-O-methyl ribonucleotide
  modified_base (20)..(21): phosphorothioate linked nucleoside
uccgaucacacagacaaccuu

SEQ ID NO: 4261 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (20)..(21): phosphorothioate linked nucleoside
uccgaucacacagacaaccuu

SEQ ID NO: 4262 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (20)..(21): phosphorothioate linked nucleoside
uccgaucacacagacaaccuu

SEQ ID NO: 4263 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (1)..(21): Positions 2-3, 20-21 phosphorothioate linked nucleoside
uccgaucacacagacaaccuu

SEQ ID NO: 4264 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
uccgaucacacagacaaccuu

SEQ ID NO: 4265 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (1)..(21): Positions 2-3, 20-21 phosphorothioate linked nucleoside
uccgaucacacagacaaccuu

SEQ ID NO: 4266 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
uccgaucacacagacaaccuu

SEQ ID NO: 4267 - DNA, 21 bp, Artificial Sequence
  Synthetic polynucleotide
  modified_base (1)..(21): Positions 2, 4, 6, 8, 10, 12-13, 16, 18, 20 2'-deoxy-2'-fluoro ("2'-fluoro") ribonucleotide
  modified_base (1)..(21): Positions 1, 3, 5, 7, 9, 11, 14-15, 17, 19, 21 2'-O-methyl ribonucleotide
  modified_base (20)..(21): phosphorothioate linked nucleoside
uccgaucacacagacaaccuu

SEQ ID NO: 4268 - DNA, 21 bp, Artificial Sequence
  Synthetic polynucleotide
  modified_base (1)..(21): Positions 2, 4, 6, 8, 10, 12, 15-16, 18, 20 2'-deoxy-2'-fluoro ("2'-fluoro") ribonucleotide
  modified_base (1)..(21): Positions 1, 3, 5, 7, 9, 11, 13-14, 17, 19, 21 2'-O-methyl ribonucleotide
  modified_base (20)..(21): phosphorothioate linked nucleoside
uccgaucacacagacaaccuu

SEQ ID NO: 4269 - DNA, 21 bp, Artificial Sequence
  Synthetic polynucleotide
  modified_base (1)..(21): Positions 2, 4, 6, 8, 10, 12, 14-15, 18, 20 2'-deoxy-2'-fluoro ("2'-fluoro") ribonucleotide
  modified_base (1)..(21): Positions 1, 3, 5, 7, 9, 11, 13, 16-17, 19, 21 2'-O-methyl ribonucleotide
  modified_base (20)..(21): phosphorothioate linked nucleoside
uccgaucacacagacaaccuu

SEQ ID NO: 4270 - DNA, 21 bp, Artificial Sequence
  Synthetic polynucleotide
  modified_base (1)..(21): Positions 2, 4, 6, 8, 10, 12, 14, 17-18, 20 2'-deoxy-2'-fluoro ("2'-fluoro") ribonucleotide
  modified_base (1)..(21): Positions 1, 3, 5, 7, 9, 11, 13, 15-16, 19, 21 2'-O-methyl ribonucleotide
  modified_base (20)..(21): phosphorothioate linked nucleoside
uccgaucacacagacaaccuu

SEQ ID NO: 4271 - DNA, 21 bp, Artificial Sequence
  Synthetic polynucleotide
  modified_base (1)..(21): Positions 2, 4, 6, 8, 10, 12, 14, 16-17, 20 2'-deoxy-2'-fluoro ("2'-fluoro") ribonucleotide
  modified_base (1)..(21): Positions 1, 3, 5, 7, 9, 11, 13, 15, 18-19, 21 2'-O-methyl ribonucleotide
  modified_base (20)..(21): phosphorothioate linked nucleoside
uccgaucacacagacaaccuu

SEQ ID NO: 4272 - DNA, 21 bp, Artificial Sequence
  Synthetic polynucleotide
  modified_base (1)..(21): Positions 2, 4, 6, 8, 10, 12, 14, 16, 19-20 2'-deoxy-2'-fluoro ("2'-fluoro") ribonucleotide
  modified_base (1)..(21): Positions 1, 3, 5, 7, 9, 11, 13, 15, 17-18, 21 2'-O-methyl ribonucleotide
  modified_base (20)..(21): phosphorothioate linked nucleoside
uccgaucacacagacaaccuu

SEQ ID NO: 4273 - DNA, 21 bp, Artificial Sequence
  Synthetic polynucleotide
  modified_base (1)..(21): Positions 2, 4, 6, 8, 10, 12, 14, 16, 18-19 2'-deoxy-2'-fluoro ("2'-fluoro") ribonucleotide
  modified_base (1)..(21): Positions 1, 3, 5, 7, 9, 11, 13, 15, 17, 20-21 2'-O-methyl ribonucleotide
  modified_base (20)..(21): phosphorothioate linked nucleoside
uccgaucacacagacaaccuu

SEQ ID NO: 4274 - DNA, 21 bp, Artificial Sequence
  Synthetic polynucleotide
  modified_base (1)..(21): Positions 2, 4, 7-8, 10, 12, 14, 16, 18, 20 2'-deoxy-2'-fluoro ("2'-fluoro") ribonucleotide
  modified_base (1)..(21): Positions 1, 3, 5-6, 9, 11, 13, 15, 17, 19, 21 2'-O-methyl ribonucleotide
  modified_base (20)..(21): phosphorothioate linked nucleoside
uccgaucacacagacaaccuu

SEQ ID NO: 4275 - DNA, 21 bp, Artificial Sequence
  Synthetic polynucleotide
  modified_base (1)..(21): Positions 2, 4-5, 8, 10, 12, 14, 16, 18, 20 2'-deoxy-2'-fluoro ("2'-fluoro") ribonucleotide
  modified_base (1)..(21): Positions 1, 3, 6-7, 9, 11, 13, 15, 17, 19, 21 2'-O-methyl ribonucleotide
  modified_base (20)..(21): phosphorothioate linked nucleoside
uccgaucacacagacaaccuu

SEQ ID NO: 4276 - DNA, 21 bp, Artificial Sequence
  Synthetic polynucleotide
  modified_base (1)..(21): Positions 2, 5-6, 8, 10, 12, 14, 16, 18, 20 2'-deoxy-2'-fluoro ("2'-fluoro") ribonucleotide
  modified_base (1)..(21): Positions 1, 3-4, 7, 9, 11, 13, 15, 17, 19, 21 2'-O-methyl ribonucleotide
  modified_base (20)..(21): phosphorothioate linked nucleoside
uccgaucacacagacaaccuu

SEQ ID NO: 4277 - DNA, 21 bp, Artificial Sequence
  Synthetic polynucleotide
  modified_base (1)..(21): Positions 2-3, 6, 8, 10, 12, 14, 16, 18, 20 2'-deoxy-2'-fluoro ("2'-fluoro") ribonucleotide
  modified_base (1)..(21): Positions 1, 4-5, 7, 9, 11, 13, 15, 17, 19, 21 2'-O-methyl ribonucleotide
  modified_base (20)..(21): phosphorothioate linked nucleoside
uccgaucacacagacaaccuu

SEQ ID NO: 4278 - DNA, 21 bp, Artificial Sequence
  Synthetic polynucleotide
  modified_base (1)..(21): Positions 3-4, 6, 8, 10, 12, 14, 16, 18, 20 2'-deoxy-2'-fluoro ("2'-fluoro") ribonucleotide
  modified_base (1)..(21): Positions 1-2, 5, 7, 9, 11, 13, 15, 17, 19, 21 2'-O-methyl ribonucleotide
  modified_base (20)..(21): phosphorothioate linked nucleoside
uccgaucacacagacaaccuu

SEQ ID NO: 4279 - DNA, 21 bp, Artificial Sequence
  Synthetic polynucleotide
  modified_base (1)..(21): Positions 1, 4, 6, 8, 10, 12, 14, 16, 18, 20 2'-deoxy-2'-fluoro ("2'-fluoro") ribonucleotide
  modified_base (1)..(21): Positions 2-3, 5, 7, 9, 11, 13, 15, 17, 19, 21 2'-O-methyl ribonucleotide
  modified_base (20)..(21): phosphorothioate linked nucleoside
uccgaucacacagacaaccuu

SEQ ID NO: 4280 - DNA, 21 bp, Artificial Sequence
  Synthetic polynucleotide
  modified_base (1)..(21): Positions 1-2, 4, 6, 8, 10, 12, 14, 16, 18, 20 2'-deoxy-2'-fluoro ("2'-fluoro") ribonucleotide
  modified_base (1)..(21): Positions 3, 5, 7, 9, 11, 13, 15, 17, 19, 21 2'-O-methyl ribonucleotide
  modified_base (20)..(21): phosphorothioate linked nucleoside
uccgaucacacagacaaccuu

SEQ ID NO: 4281 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
  modified_base (20)..(21): phosphorothioate linked nucleoside
uccgaucacacagacaaccuu

SEQ ID NO: 4282 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
  modified_base (20)..(21): phosphorothioate linked nucleoside
uccgaucacacagacaaccuu

SEQ ID NO: 4283 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
  modified_base (20)..(21): phosphorothioate linked nucleoside
uccgaucacacagacaaccuu

SEQ ID NO: 4284 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
  modified_base (20)..(21): phosphorothioate linked nucleoside
uccgaucacacagacaaccuu

SEQ ID NO: 4285 - DNA, 21 bp, Artificial Sequence
  Synthetic polynucleotide
  modified_base (13)..(13): 2'-O-methyl ribonucleotide
  modified_base (21)..(21): phosphorothioate linked nucleoside
aagcccgucucguaguccgtt

SEQ ID NO: 4286 - DNA, 21 bp, Artificial Sequence
  Synthetic polynucleotide
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (20)..(21): phosphorothioate linked nucleoside
aagcccgucucguaguccguu

SEQ ID NO: 4287 - DNA, 21 bp, Artificial Sequence
  Synthetic polynucleotide
  modified_base (1)..(21): Positions 2, 4, 6, 8, 11, 14, 16, 18, 20 2'-deoxy-2'-fluoro ("2'-fluoro") ribonucleotide
  modified_base (1)..(21): Positions 1, 3, 5, 7, 9-10, 12-13, 15, 17, 19, 21 2'-O-methyl ribonucleotide
  modified_base (20)..(21): phosphorothioate linked nucleoside
aagcccgucucguaguccguu

SEQ ID NO: 4288 - DNA, 21 bp, Artificial Sequence
  Synthetic polynucleotide
  modified_base (1)..(21): Positions 2, 4, 6, 8, 11-12, 14, 16, 18, 20 2'-deoxy-2'-fluoro ("2'-fluoro") ribonucleotide
  modified_base (1)..(21): Positions 1, 3, 5, 7, 9,-10, 13, 15, 17, 19, 21 2'-O-methyl ribonucleotide
  modified_base (20)..(21): phosphorothioate linked nucleoside
aagcccgucucguaguccguu

SEQ ID NO: 4289 - DNA, 21 bp, Artificial Sequence
  Synthetic polynucleotide
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (20)..(21): phosphorothioate linked nucleoside
aagcccgucucguaguccguu

SEQ ID NO: 4290 - DNA, 21 bp, Artificial Sequence
  Synthetic polynucleotide
  modified_base (1)..(21): Positions 2, 4, 6, 9, 12, 14, 16, 18, 20 2'-deoxy-2'-fluoro ("2'-fluoro") ribonucleotide
  modified_base (1)..(21): Positions 1, 3, 5, 7-8, 10-11, 13, 15, 17, 19, 21 2'-O-methyl ribonucleotide
  modified_base (20)..(21): phosphorothioate linked nucleoside
aagcccgucucguaguccguu

SEQ ID NO: 4291 - DNA, 21 bp, Artificial Sequence
  Synthetic polynucleotide
  modified_base (1)..(21): Positions 2, 4, 6, 8-9, 12, 14, 16, 18, 20 2'-deoxy-2'-fluoro ("2'-fluoro") ribonucleotide
  modified_base (1)..(21): Positions 1, 3, 5, 7, 10-11, 13, 15, 17, 19, 21 2'-O-methyl ribonucleotide
  modified_base (20)..(21): phosphorothioate linked nucleoside
aagcccgucucguaguccguu

SEQ ID NO: 4292 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (20)..(21): phosphorothioate linked nucleoside
aagcccgucucguaguccguu

SEQ ID NO: 4293 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (20)..(21): phosphorothioate linked nucleoside
aagcccgucucguaguccguu

SEQ ID NO: 4294 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (1)..(21): Positions 2-3, 20-21 phosphorothioate linked nucleoside
aagcccgucucguaguccguu

SEQ ID NO: 4295 - DNA, 21 bp, Artificial Sequence
  Synthetic polynucleotide
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
aagcccgucucguaguccguu

SEQ ID NO: 4296 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (1)..(21): Positions 2-3, 20-21 phosphorothioate linked nucleoside
aagcccgucucguaguccguu

SEQ ID NO: 4297 - DNA, 21 bp, Artificial Sequence
  Synthetic polynucleotide
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
aagcccgucucguaguccguu

SEQ ID NO: 4298 - DNA, 21 bp, Artificial Sequence
  Synthetic polynucleotide
  modified_base (1)..(21): Positions 2, 4, 6, 8, 10, 12-13, 16, 18, 20 2'-deoxy-2'-fluoro ("2'-fluoro") ribonucleotide
  modified_base (1)..(21): Positions 1, 3, 5, 7, 9, 11, 14-15, 17, 19, 21 2'-O-methyl ribonucleotide
  modified_base (20)..(21): phosphorothioate linked nucleoside
aagcccgucucguaguccguu

SEQ ID NO: 4299 - DNA, 21 bp, Artificial Sequence
  Synthetic polynucleotide
  modified_base (1)..(21): Positions 2, 4, 6, 8, 10, 12, 15-16, 18, 20 2'-deoxy-2'-fluoro ("2'-fluoro") ribonucleotide
  modified_base (1)..(21): Positions 1, 3, 5, 7, 9, 11, 13-14, 17, 19, 21 2'-O-methyl ribonucleotide
  modified_base (20)..(21): phosphorothioate linked nucleoside
aagcccgucucguaguccguu

SEQ ID NO: 4300 - DNA, 21 bp, Artificial Sequence
  Synthetic polynucleotide
  modified_base (1)..(21): Positions 2, 4, 6, 8, 10, 12, 14-15, 18, 20 2'-deoxy-2'-fluoro ("2'-fluoro") ribonucleotide
  modified_base (1)..(21): Positions 1, 3, 5, 7, 9, 11, 13, 16-17, 19, 21 2'-O-methyl ribonucleotide
  modified_base (20)..(21): phosphorothioate linked nucleoside
aagcccgucucguaguccguu

SEQ ID NO: 4301 - DNA, 21 bp, Artificial Sequence
  Synthetic polynucleotide
  modified_base (1)..(21): Positions 2, 4, 6, 8, 10, 12, 14, 17-18, 20 2'-deoxy-2'-fluoro ("2'-fluoro") ribonucleotide
  modified_base (1)..(21): Positions 1, 3, 5, 7, 9, 11, 13, 15-16, 19, 21 2'-O-methyl ribonucleotide
  modified_base (20)..(21): phosphorothioate linked nucleoside
aagcccgucucguaguccguu

SEQ ID NO: 4302 - DNA, 21 bp, Artificial Sequence
  Synthetic polynucleotide
  modified_base (1)..(21): Positions 2, 4, 6, 8, 10, 12, 14, 16-17, 20 2'-deoxy-2'-fluoro ("2'-fluoro") ribonucleotide
  modified_base (1)..(21): Positions 1, 3, 5, 7, 9, 11, 13, 15, 18-19, 21 2'-O-methyl ribonucleotide
  modified_base (20)..(21): phosphorothioate linked nucleoside
aagcccgucucguaguccguu

SEQ ID NO: 4303 - DNA, 21 bp, Artificial Sequence
  Synthetic polynucleotide
  modified_base (1)..(21): Positions 2, 4, 6, 8, 10, 12, 14, 16, 19- 20 2'-deoxy-2'-fluoro ("2'-fluoro") ribonucleotide
  modified_base (1)..(21): Positions 1, 3, 5, 7, 9, 11, 13, 15, 17-18, 21 2'-O-methyl ribonucleotide
  modified_base (20)..(21): phosphorothioate linked nucleoside
aagcccgucucguaguccguu

SEQ ID NO: 4304 - DNA, 21 bp, Artificial Sequence
  Synthetic polynucleotide
  modified_base (1)..(21): Positions 2, 4, 6, 8, 10, 12, 14, 16, 18-19 2'-deoxy-2'-fluoro ("2'-fluoro") ribonucleotide
  modified_base (1)..(21): Positions 1, 3, 5, 7, 9, 11, 13, 15, 17, 20-21 2'-O-methyl ribonucleotide
  modified_base (20)..(21): phosphorothioate linked nucleoside
aagcccgucucguaguccguu

SEQ ID NO: 4305 - DNA, 21 bp, Artificial Sequence
  Synthetic polynucleotide
  modified_base (1)..(21): Positions 2, 4, 7-8, 10, 12, 14, 16, 18, 20 2'-deoxy-2'-fluoro ("2'-fluoro") ribonucleotide
  modified_base (1)..(21): Positions 1, 3, 5-6, 9, 11, 13, 15, 17, 19, 21 2'-O-methyl ribonucleotide
  modified_base (20)..(21): phosphorothioate linked nucleoside
aagcccgucucguaguccguu

SEQ ID NO: 4306 - DNA, 21 bp, Artificial Sequence
  Synthetic polynucleotide
  modified_base (1)..(21): Positions 2, 4-5, 8, 10, 12, 14, 16, 18, 20 2'-deoxy-2'-fluoro ("2'-fluoro") ribonucleotide
  modified_base (1)..(21): Positions 1, 3, 6-7, 9, 11, 13, 15, 17, 19, 21 2'-O-methyl ribonucleotide
  modified_base (20)..(21): phosphorothioate linked nucleoside
aagcccgucucguaguccguu

SEQ ID NO: 4307 - DNA, 21 bp, Artificial Sequence
  Synthetic polynucleotide
  modified_base (1)..(21): Positions 2, 5-6, 8, 10, 12, 14, 16, 18, 20 2'-deoxy-2'-fluoro ("2'-fluoro") ribonucleotide
  modified_base (1)..(21): Positions 1, 3-4, 7, 9, 11, 13, 15, 17, 19, 21 2'-O-methyl ribonucleotide
  modified_base (20)..(21): phosphorothioate linked nucleoside
aagcccgucucguaguccguu

SEQ ID NO: 4308 - DNA, 21 bp, Artificial Sequence
  Synthetic polynucleotide
  modified_base (1)..(21): Positions 2-3, 6, 8, 10, 12, 14, 16, 18, 20 2'-deoxy-2'-fluoro ("2'-fluoro") ribonucleotide
  modified_base (1)..(21): Positions 1, 4-5, 7, 9, 11, 13, 15, 17, 19, 21 2'-O-methyl ribonucleotide
  modified_base (20)..(21): phosphorothioate linked nucleoside
aagcccgucucguaguccguu

SEQ ID NO: 4309 - DNA, 21 bp, Artificial Sequence
  Synthetic polynucleotide
  modified_base (1)..(21): Positions 3-4, 6, 8, 10, 12, 14, 16, 18, 20 2'-deoxy-2'-fluoro ("2'-fluoro") ribonucleotide
  modified_base (1)..(21): Positions 1-2, 5, 7, 9, 11, 13, 15, 17, 19, 21 2'-O-methyl ribonucleotide
  modified_base (20)..(21): phosphorothioate linked nucleoside
aagcccgucucguaguccguu

SEQ ID NO: 4310 - DNA, 21 bp, Artificial Sequence
  Synthetic polynucleotide
  modified_base (1)..(21): Positions 1, 4, 6, 8, 10, 12, 14, 16, 18, 20 2'-deoxy-2'-fluoro ("2'-fluoro") ribonucleotide
  modified_base (1)..(21): Positions 2-3, 5, 7, 9, 11, 13, 15, 17, 19, 21 2'-O-methyl ribonucleotide
  modified_base (20)..(21): phosphorothioate linked nucleoside
aagcccgucucguaguccguu

SEQ ID NO: 4311 - DNA, 21 bp, Artificial Sequence
  Synthetic polynucleotide
  modified_base (1)..(21): Positions 1-2, 4, 6, 8, 10, 12, 14, 16, 18, 20 2'-deoxy-2'-fluoro ("2'-fluoro") ribonucleotide
  modified_base (1)..(21): Positions 3, 5, 7, 9, 11, 13, 15, 17, 19, 21 2'-O-methyl ribonucleotide
  modified_base (20)..(21): phosphorothioate linked nucleoside
aagcccgucucguaguccguu

SEQ ID NO: 4312 - DNA, 21 bp, Artificial Sequence
  Synthetic polynucleotide
  modified_base (1)..(21): Positions 1, 4-5, 8-9, 12-13, 16-17, 20-21 2'-deoxy-2'-fluoro ("2'-fluoro") ribonucleotide
  modified_base (1)..(21): Positions 2-3, 6-7, 10-11, 14-15, 18-19 2'-O-methyl ribonucleotide
  modified_base (20)..(21): phosphorothioate linked nucleoside
aagcccgucucguaguccguu

SEQ ID NO: 4313 - DNA, 21 bp, Artificial Sequence
  Synthetic polynucleotide
  modified_base (1)..(21): Positions 2-3, 6-7, 10-11, 14-15, 18-19 2'-deoxy-2'-fluoro ("2'-fluoro") ribonucleotide
  modified_base (1)..(21): Positions 1, 4-5, 8-9, 12-13, 16-17, 20-21 2'-O-methyl ribonucleotide
  modified_base (20)..(21): phosphorothioate linked nucleoside
aagcccgucucguaguccguu

SEQ ID NO: 4314 - DNA, 21 bp, Artificial Sequence
  Synthetic polynucleotide
  modified_base (1)..(21): Positions 1-2, 5-6, 9-10, 13-14, 17-18, 21 2'-deoxy-2'-fluoro ("2'-fluoro") ribonucleotide
  modified_base (1)..(21): Positions 3-4, 7-8, 11-12, 15-16, 19-20 2'-O-methyl ribonucleotide
  modified_base (20)..(21): phosphorothioate linked nucleoside
aagcccgucucguaguccguu

SEQ ID NO: 4315 - DNA, 21 bp, Artificial Sequence
  Synthetic polynucleotide
  modified_base (1)..(21): Positions 3-4, 7-8, 11-12, 15-16, 19-20 2'-deoxy-2'-fluoro ("2'-fluoro") ribonucleotide
  modified_base (1)..(21): Positions 1-2, 5-6, 9-10, 13-14, 17-18, 21 2'-O-methyl ribonucleotide
  modified_base (20)..(21): phosphorothioate linked nucleoside
aagcccgucucguaguccguu

SEQ ID NO: 4316 - RNA, 19 nt, Homo sapiens
uuacaucguuaaugcguua

SEQ ID NO: 4317 - RNA, 19 nt, Homo sapiens
acuucacagcgagcacgga

SEQ ID NO: 4318 - RNA, 19 nt, Homo sapiens
gcaucuuggugaaacguga

SEQ ID NO: 4319 - DNA, 21 bp, Artificial Sequence
  Synthetic polynucleotide
  modified_base (1)..(1): 5'-monophosphate
  modified_base (1)..(21): Positions 1, 3, 5, 7-10, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
gugggaagaaagaugaaguuu

SEQ ID NO: 4320 - DNA, 21 bp, Artificial Sequence
  Synthetic polynucleotide
  modified_base (1)..(1): 5'-monophosphate
  modified_base (1)..(21): Positions 1, 3, 5, 7-8, 10-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
gugggaagaaagaugaaguuu

SEQ ID NO: 4321 - DNA, 21 bp, Artificial Sequence
  Synthetic polynucleotide
  modified_base (1)..(1): 5'-monophosphate
  modified_base (1)..(21): Positions 1, 3, 5, 7, 10-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
  modified_base (2)..(3): phosphorothioate linked nucleoside
gugggaagaaagaugaaguuu

SEQ ID NO: 4322 - DNA, 21 bp, Artificial Sequence
  Synthetic polynucleotide
  modified_base (1)..(1): 5'-monophosphate
  modified_base (1)..(21): Positions 1, 3, 5, 7, 9-10, 12-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
  modified_base (2)..(3): phosphorothioate linked nucleoside
gugggaagaaagaugaaguuu

SEQ ID NO: 4323 - DNA, 21 bp, Artificial Sequence
  Synthetic polynucleotide
  modified_base (1)..(1): 5'-monophosphate
  modified_base (1)..(21): Positions 1, 3, 5, 8-9, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (2)..(3): phosphorothioate linked nucleoside
gugggaagaaagaugaaguuu

SEQ ID NO: 4324 - DNA, 21 bp, Artificial Sequence
  Synthetic polynucleotide
  modified_base (1)..(1): 5'-monophosphate
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 12, 14, 16, 18, 20 2'-O-methyl ribonucleotide
  modified_base (2)..(3): phosphorothioate linked nucleoside
gugggaagaaagaugaaguuu

SEQ ID NO: 4325 - DNA, 21 bp, Artificial Sequence
  Synthetic polynucleotide
  modified_base (1)..(1): 5'-monophosphate
  modified_base (1)..(21): Positions 1, 3, 5, 8, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (2)..(3): phosphorothioate linked nucleoside
gugggaagaaagaugaaguuu

SEQ ID NO: 4326 - DNA, 21 bp, Artificial Sequence
  Synthetic polynucleotide
  modified_base (1)..(1): 5'-monophosphate
  modified_base (1)..(21): Positions 7, 9 2'-deoxy-2'-fluoro ("2'-fluoro") ribonucleotide
  modified_base (1)..(21): Positions 1-6, 8, 10, 12-21 2'-O-methyl ribonucleotide
  modified_base (2)..(3): phosphorothioate linked nucleoside
gugggaagaaagaugaaguuu

SEQ ID NO: 4327 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17 2'-deoxy-2'-fluoro ("2'-fluoro") ribonucleotide
  modified_base (1)..(21): Positions 2, 4, 6, 12, 14, 16, 18-21 2'-O-methyl ribonucleotide
  modified_base (2)..(3): phosphorothioate linked nucleoside
gugggaagaaagaugaaguuu

SEQ ID NO: 4328 - DNA, 21 bp, Artificial Sequence
  Synthetic polynucleotide
  modified_base (1)..(1): 5'-monophosphate
  modified_base (1)..(21): Positions 1, 3, 5, 7, 9, 11, 13, 15, 17, 19, 21 2'-deoxy-2'-fluoro ("2'-fluoro") ribonucleotide
  modified_base (1)..(21): Positions 2, 4, 6, 8, 10, 12, 14, 16, 18, 20 2'-O-methyl ribonucleotide
  modified_base (2)..(3): phosphorothioate linked nucleoside
gcagcugcuacugguucucuu

SEQ ID NO: 4329 - DNA, 21 bp, Artificial Sequence
  Synthetic polynucleotide
  modified_base (1)..(1): 5'-monophosphate
  modified_base (1)..(21): Positions 1, 3, 5, 8-11, 13, 15, 17, 19, 21 2'-deoxy-2'-fluoro ("2'-fluoro") ribonucleotide
  modified_base (1)..(21): Positions 2, 4, 6-7, 12, 14, 16, 18, 20 2'-O-methyl ribonucleotide
  modified_base (2)..(3): phosphorothioate linked nucleoside
gcagcugcuacugguucucuu

SEQ ID NO: 4330 - DNA, 21 bp, Artificial Sequence
  Synthetic polynucleotide
  modified_base (1)..(1): 5'-monophosphate
  modified_base (1)..(21): Positions 2, 4, 6, 8-11, 13, 15, 17, 19, 21 2'-deoxy-2'-fluoro ("2'-fluoro") ribonucleotide
  modified_base (1)..(21): Positions 1, 3, 5, 7, 12, 14, 16, 18, 20 2'-O-methyl ribonucleotide
  modified_base (2)..(3): phosphorothioate linked nucleoside
gcagcugcuacugguucucuu

SEQ ID NO: 4331 - DNA, 21 bp, Artificial Sequence
  Synthetic polynucleotide
  modified_base (1)..(1): 5'-monophosphate
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (2)..(3): phosphorothioate linked nucleoside
gcagcugcuacugguucucuu

SEQ ID NO: 4332 - DNA, 21 bp, Artificial Sequence
  Synthetic polynucleotide
  modified_base (1)..(1): 5'-monophosphate
  modified_base (1)..(21): Positions 1, 3, 5, 7, 9-12, 14, 16, 18, 20 2'-deoxy-2'-fluoro ("2'-fluoro") ribonucleotide
  modified_base (1)..(21): Positions 2, 4, 6, 8, 13, 15, 17, 19, 21 2'-O-methyl ribonucleotide
  modified_base (2)..(3): phosphorothioate linked nucleoside
gcagcugcuacugguucucuu

SEQ ID NO: 4333 - DNA, 21 bp, Artificial Sequence
  Synthetic polynucleotide
  modified_base (1)..(1): 5'-monophosphate
  modified_base (1)..(21): Positions 1, 3, 5, 7-10, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
gcagcugcuacugguucucuu

SEQ ID NO: 4334 - DNA, 21 bp, Artificial Sequence
  Synthetic polynucleotide
  modified_base (1)..(1): 5'-monophosphate
  modified_base (1)..(21): Positions 1, 3, 5, 7-8, 10-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
gcagcugctacugguucucuu

SEQ ID NO: 4335 - DNA, 21 bp, Artificial Sequence
  Synthetic polynucleotide
  modified_base (1)..(1): 5'-monophosphate
  modified_base (1)..(21): Positions 1, 3, 5, 7, 10-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
  modified_base (2)..(3): phosphorothioate linked nucleoside
gcagcugctacugguucucuu

SEQ ID NO: 4336 - DNA, 21 bp, Artificial Sequence
  Synthetic polynucleotide
  modified_base (1)..(1): 5'-monophosphate
  modified_base (1)..(21): Positions 1, 3, 5, 7, 9-10, 12-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
  modified_base (2)..(3): phosphorothioate linked nucleoside
gcagcugcuacugguucucuu

SEQ ID NO: 4337 - DNA, 21 bp, Artificial Sequence
  Synthetic polynucleotide
  modified_base (1)..(1): 5'-monophosphate
  modified_base (1)..(21): Positions 1, 3, 5, 8-9, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (2)..(3): phosphorothioate linked nucleoside
gcagcugcuacugguucucuu

SEQ ID NO: 4338 - DNA, 21 bp, Artificial Sequence
  Synthetic polynucleotide
  modified_base (1)..(1): 5'-monophosphate
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 12, 14, 16, 18, 20 2'-O-methyl ribonucleotide
  modified_base (2)..(3): phosphorothioate linked nucleoside
gcagcugcuacugguucucuu

SEQ ID NO: 4339 - DNA, 21 bp, Artificial Sequence
  Synthetic polynucleotide
  modified_base (1)..(1): 5'-monophosphate
  modified_base (1)..(21): Positions 1, 3, 5, 8, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (2)..(3): phosphorothioate linked nucleoside
gcagcugctacugguucucuu

SEQ ID NO: 4340 - DNA, 21 bp, Artificial Sequence
  Synthetic polynucleotide
  modified_base (1)..(1): 5'-monophosphate
  modified_base (1)..(21): Positions 7, 9 2'-deoxy-2'-fluoro ("2'-fluoro") ribonucleotide
  modified_base (1)..(21): Positions 1-6, 8, 10, 12-21 2'-O-methyl ribonucleotide
  modified_base (2)..(3): phosphorothioate linked nucleoside
gcagcugcuacugguucucuu

SEQ ID NO: 4341 - DNA, 21 bp, Artificial Sequence
  Synthetic polynucleotide
  modified_base (1)..(1): 5'-monophosphate
  modified_base (1)..(21): Positions 1, 3, 5, 7-8, 10-11, 13, 19 2'-deoxy-2'-fluoro ("2'-fluoro") ribonucleotide
  modified_base (1)..(21): Positions 2, 4, 6, 9, 12, 14-18, 20-21 2'-O-methyl ribonucleotide
  modified_base (2)..(3): phosphorothioate linked nucleoside
gcagcugcuacugguucucuu

SEQ ID NO: 4342 - DNA, 21 bp, Artificial Sequence
  Synthetic polynucleotide
  modified_base (1)..(1): 5'-monophosphate
  modified_base (1)..(21): Positions 1, 3, 5, 7, 9, 11, 13, 15, 17, 19, 21 2'-deoxy-2'-fluoro ("2'-fluoro") ribonucleotide
  modified_base (1)..(21): Positions 2, 4, 6, 8, 10, 12, 14, 16, 18, 20 2'-O-methyl ribonucleotide
  modified_base (2)..(3): phosphorothioate linked nucleoside
ugugggaagaaagaugaaguu

SEQ ID NO: 4343 - DNA, 21 bp, Artificial Sequence
  Synthetic polynucleotide
  modified_base (1)..(1): 5'-monophosphate
  modified_base (1)..(21): Positions 1, 3, 5, 8-11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (2)..(3): phosphorothioate linked nucleoside
ugugggaagaaagaugaaguu

SEQ ID NO: 4344 - DNA, 21 bp, Artificial Sequence
  Synthetic polynucleotide
  modified_base (1)..(1): 5'-monophosphate
  modified_base (1)..(21): Positions 7, 9 2'-deoxy-2'-fluoro ("2'-fluoro") ribonucleotide
  modified_base (1)..(21): Positions 1-6, 8, 10, 12-21 2'-O-methyl ribonucleotide
  modified_base (2)..(3): phosphorothioate linked nucleoside
ugugggaagaaagaugaaguu

SEQ ID NO: 4345 - DNA, 21 bp, Artificial Sequence
  Synthetic polynucleotide
  modified_base (1)..(1): 5'-monophosphate
  modified_base (1)..(21): Positions 5, 7-11, 13, 19 2'-deoxy-2'-fluoro ("2'-fluoro") ribonucleotide
  modified_base (1)..(21): Positions 1-4, 6, 12, 14-18, 20-21 2'-O-methyl ribonucleotide
  modified_base (2)..(3): phosphorothioate linked nucleoside
ugugggaagaaagaugaaguu

SEQ ID NO: 4346 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
gugggaagaaagaugaaguuu

SEQ ID NO: 4347 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
gcagcugcuacugguucucuu

SEQ ID NO: 4348 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
ugugggaagaaagaugaaguu

SEQ ID NO: 4349 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
aggacugugcccacuucacuu

SEQ ID NO: 4350 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
gagacgggcuucaagaacuuu

SEQ ID NO: 4351 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
gagcgcagcugcuacugguuu

SEQ ID NO: 4352 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
guugucugugugaucggauuu

SEQ ID NO: 4353 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
ggagcugcggggccugagauu

SEQ ID NO: 4354 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
gccgcuggaacgacgacguuu

SEQ ID NO: 4355 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
gcugggucugcgagacagauu

SEQ ID NO: 4356 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
gcuuucucgggaauuuucauu

SEQ ID NO: 4357 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
ccuccugcugcuugugguuuu

SEQ ID NO: 4358 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
cuaucaugaccaaggaguauu

SEQ ID NO: 4359 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
cguccugggaggagcagaauu

SEQ ID NO: 4360 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6,12, 14, 16, 18, 20 2'-O-methyl ribonucleotide
cugggggccucuucugcuuuu

SEQ ID NO: 4361 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
ccuaucaugaccaaggaguuu

SEQ ID NO: 4362 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
gauagggugauguuccgaauu

SEQ ID NO: 4363 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
gcaguuugcagguuaucauuu

SEQ ID NO: 4364 - DNA, 21 bp, Artificial Sequence
  Synthetic polynucleotide
  modified_base (1)..(1): 5'-monophosphate
  modified_base (1)..(21): Positions 1, 3, 5, 7, 9-11, 13, 15, 17, 19, 21 2'-deoxy-2'-fluoro ("2'-fluoro") ribonucleotide
  modified_base (1)..(21): Positions 2, 4, 6, 8, 12, 14, 16, 18, 20 2'-O-methyl ribonucleotide
  modified_base (2)..(3): phosphorothioate linked nucleoside
gugggaagaaagaugaagucg

SEQ ID NO: 4365 - DNA, 21 bp, Artificial Sequence
  Synthetic polynucleotide
  modified_base (1)..(1): 5'-monophosphate
  modified_base (1)..(21): Positions 1, 3, 5, 7, 9-11, 13, 15, 17, 19, 21 2'-deoxy-2'-fluoro ("2'-fluoro") ribonucleotide
  modified_base (1)..(21): Positions 2, 4, 6, 8, 12, 14, 16, 18, 20 2'-O-methyl ribonucleotide
  modified_base (2)..(3): phosphorothioate linked nucleoside
gcagcugcuacugguucucuc

SEQ ID NO: 4366 - DNA, 21 bp, Artificial Sequence
  Synthetic polynucleotide
  modified_base (1)..(1): 5'-monophosphate
  modified_base (1)..(21): Positions 1, 3, 5, 7, 9-11, 13, 15, 17, 19, 21 2'-deoxy-2'-fluoro ("2'-fluoro") ribonucleotide
  modified_base (1)..(21): Positions 2, 4, 6, 8, 12, 14, 16, 18, 20 2'-O-methyl ribonucleotide
  modified_base (2)..(3): phosphorothioate linked nucleoside
ugugggaagaaagaugaaguc

SEQ ID NO: 4367 - DNA, 21 bp, Artificial Sequence
  Synthetic polynucleotide
  modified_base (1)..(1): 5'-monophosphate
  modified_base (1)..(21): Positions 1, 3, 5, 7, 9-11, 13, 15, 17, 19, 21 2'-deoxy-2'-fluoro ("2'-fluoro") ribonucleotide
  modified_base (1)..(21): Positions 2, 4, 6, 8, 12, 14, 16, 18, 20 2'-O-methyl ribonucleotide
  modified_base (2)..(3): phosphorothioate linked nucleoside
augugggaagaaagaugaagu

SEQ ID NO: 4368 - DNA, 21 bp, Artificial Sequence
  Synthetic polynucleotide
  modified_base (1)..(1): 5'-monophosphate
  modified_base (1)..(21): Positions 1, 3, 5, 7, 9-11, 13, 15, 17, 19, 21 2'-deoxy-2'-fluoro ("2'-fluoro") ribonucleotide
  modified_base (1)..(21): Positions 2, 4, 6, 8, 12, 14, 16, 18, 20 2'-O-methyl ribonucleotide
  modified_base (2)..(3): phosphorothioate linked nucleoside
gcgcagcugcuacugguucuc

SEQ ID NO: 4369 - DNA, 21 bp, Artificial Sequence
  Synthetic polynucleotide
  modified_base (1)..(1): 5'-monophosphate
  modified_base (1)..(21): Positions 1, 3, 5, 7, 9-11, 13, 15, 17, 19, 21 2'-deoxy-2'-fluoro ("2'-fluoro") ribonucleotide
  modified_base (1)..(21): Positions 2, 4, 6, 8, 12, 14, 16, 18, 20 2'-O-methyl ribonucleotide
  modified_base (2)..(3): phosphorothioate linked nucleoside
aaugugggaagaaagaugaag

SEQ ID NO: 4370 - DNA, 21 bp, Artificial Sequence
  Synthetic polynucleotide
  modified_base (1)..(1): 5'-monophosphate
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
  modified_base (2)..(3): phosphorothioate linked nucleoside
gacgggacggacuacgagauu

SEQ ID NO: 4371 - DNA, 21 bp, Artificial Sequence
  Synthetic polynucleotide
  modified_base (1)..(1): 5'-monophosphate
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
  modified_base (2)..(3): phosphorothioate linked nucleoside
agccaccucuccuuuaauuuu

SEQ ID NO: 4372 - DNA, 21 bp, Artificial Sequence
  Synthetic polynucleotide
  modified_base (1)..(1): 5'-monophosphate
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
  modified_base (2)..(3): phosphorothioate linked nucleoside
ugaccugcggagccugagcuu

SEQ ID NO: 4373 - DNA, 21 bp, Artificial Sequence
  Synthetic polynucleotide
  modified_base (1)..(1): 5'-monophosphate
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
  modified_base (2)..(3): phosphorothioate linked nucleoside
ccugcucucccugggccucuu

SEQ ID NO: 4374 - DNA, 21 bp, Artificial Sequence
  Synthetic polynucleotide
  modified_base (1)..(1): 5'-monophosphate
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
  modified_base (2)..(3): phosphorothioate linked nucleoside
ccuccugcucucccugggcuu

SEQ ID NO: 4375 - DNA, 21 bp, Artificial Sequence
  Synthetic polynucleotide
  modified_base (1)..(1): 5'-monophosphate
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
  modified_base (2)..(3): phosphorothioate linked nucleoside
gcugcuacugguucucucguu

SEQ ID NO: 4376 - DNA, 21 bp, Artificial Sequence
  Synthetic polynucleotide
  modified_base (1)..(1): 5'-monophosphate
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
  modified_base (2)..(3): phosphorothioate linked nucleoside
cccauucuccaagcuucaguu

SEQ ID NO: 4377 - DNA, 21 bp, Artificial Sequence
  Synthetic polynucleotide
  modified_base (1)..(1): 5'-monophosphate
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
  modified_base (2)..(3): phosphorothioate linked nucleoside
acugguucucucgcuccgguu

SEQ ID NO: 4378 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
gacgggacggacuacgagauu

SEQ ID NO: 4379 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
agccaccucuccuuuaauuuu

SEQ ID NO: 4380 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
gcacgagcgcagcugcuacuu

SEQ ID NO: 4381 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6,12, 14, 16, 18, 20 2'-O-methyl ribonucleotide
  modified_base (2)..(3): phosphorothioate linked nucleoside
gcgcagcugcuacugguucuu

SEQ ID NO: 4382 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
acgggacggacuacgagacuu

SEQ ID NO: 4383 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
gcuccacgugaagcaguucuu

SEQ ID NO: 4384 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
ugaccugcggagccugagcuu

SEQ ID NO: 4385 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
gcugcggggccugagagaguu

SEQ ID NO: 4386 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
uucaccgacgacggccgcuuu

SEQ ID NO: 4387 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
ccacgaccaaaacgggcccuu

SEQ ID NO: 4388 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
ccugcucucccugggccucuu

SEQ ID NO: 4389 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
ccuccugcucucccugggcuu

SEQ ID NO: 4390 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
gggaagaaagaugaagucguu

SEQ ID NO: 4391 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
ccacuucaccgacgacggcuu

SEQ ID NO: 4392 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
gcugcuacugguucucucguu

SEQ ID NO: 4393 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
aacgggcccuggaaguggguu

SEQ ID NO: 4394 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
agcagccggacgacugguauu

SEQ ID NO: 4395 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
cugcgagacagagcuggacuu

SEQ ID NO: 4396 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
ggaggacgcgcaccugguguu

SEQ ID NO: 4397 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
ucacguccugggaggagcauu

SEQ ID NO: 4398 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleosi
aaggaccugcugcccggucuu

SEQ ID NO: 4399 - DNA, 21 bp, Artificial Sequence
  Synthetic polynucleotid
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
cccauucuccaagcuucaguu

SEQ ID NO: 4400 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
augggccuccacgaccaaauu

SEQ ID NO: 4401 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
cgacggccgcuggaacgacuu

SEQ ID NO: 4402 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
acugguucucucgcuccgguu

SEQ ID NO: 4403 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
cgaccaaaacgggcccugguu

SEQ ID NO: 4404 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
  modified_base (2)..(3): phosphorothioate linked nucleoside
ggucugcgagacagagcuguu

SEQ ID NO: 4405 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
gacgggacggacuacgagauu

SEQ ID NO: 4406 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
agccaccucuccuuuaauuuu

SEQ ID NO: 4407 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
ugaccugcggagccugagcuu

SEQ ID NO: 4408 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
ccugcucucccugggccucuu

SEQ ID NO: 4409 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
ccuccugcucucccugggcuu

SEQ ID NO: 4410 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6,12, 14, 16, 18, 20 2'-O-methyl ribonucleotide
gcugcuacugguucucucguu

SEQ ID NO: 4411 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
cccauucuccaagcuucaguu

SEQ ID NO: 4412 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-deoxy-2'-fluoro ("2'-fluoro") ribonucleotide
  modified_base (1)..(21): Positions 2, 4, 6, 12, 14, 16, 18, 20 2'-O-methyl ribonucleotide
acugguucucucgcuccgguu

SEQ ID NO: 4413 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
gcagcugcuacugguucucuu

SEQ ID NO: 4414 - DNA, 21 bp, Artificial Sequence
  Synthetic polynucleotide
  modified_base (1)..(1): 5'-monophosphate
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (2)..(3): phosphorothioate linked nucleoside
gugggaagaaagaugaaguuu

SEQ ID NO: 4415 - DNA, 21 bp, Artificial Sequence
  Synthetic polynucleotide
  modified_base (1)..(1): 5'-monophosphate
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
  modified_base (2)..(3): phosphorothioate linked nucleoside
gugggaagaaagaugaaguuu

SEQ ID NO: 4416 - DNA, 21 bp, Artificial Sequence
  Synthetic polynucleotide
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
  modified_base (20)..(21): phosphorothioate linked nucleoside
gugggaagaaagaugaaguuu

SEQ ID NO: 4417 - DNA, 21 bp, Artificial Sequence
  Synthetic polynucleotide
  modified_base (1)..(1): 5'-monophosphate
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
gugggaagaaagaugaaguuu

SEQ ID NO: 4418 - DNA, 21 bp, Artificial Sequence
  Synthetic polynucleotide
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (20)..(21): phosphorothioate linked nucleoside
gugggaagaaagaugaaguuu

SEQ ID NO: 4419 - DNA, 21 bp, Artificial Sequence
  Synthetic polynucleotide
  modified_base (1)..(21): Positions 1, 3, 5, 7, 9, 11-12, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
  modified_base (20)..(21): phosphorothioate linked nucleoside
gugggaagaaagaugaaguuu

SEQ ID NO: 4420 - DNA, 21 bp, Artificial Sequence
  Synthetic polynucleotide
  modified_base (1)..(21): Positions 1, 3, 5, 7, 9-11, 13, 15, 17, 19, 21 2'-deoxy-2'-fluoro ("2'-fluoro") ribonucleotide
  modified_base (1)..(21): Positions 2, 4, 6, 8, 12, 14, 16, 18, 20 2'-O-methyl ribonucleotide
  modified_base (20)..(21): phosphorothioate linked nucleoside
gugggaagaaagaugaaguuu

SEQ ID NO: 4421 - DNA, 21 bp, Artificial Sequence
  Synthetic polynucleotide
  modified_base (1)..(1): 5'-monophosphate
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
gugggaagaaagaugaaguuu

SEQ ID NO: 4422 - DNA, 21 bp, Artificial Sequence
  Synthetic polynucleotide
  modified_base (1)..(1): 5'-monophosphate
  modified_base (1)..(21): Positions 1, 3, 5, 7, 9, 11, 13, 15, 17, 20-21 2'-deoxy-2'-fluoro ("2'-fluoro") ribonucleotide
  modified_base (1)..(21): Positions 2, 4, 6, 8, 10, 12, 14, 16, 18-19 2'-O-methyl ribonucleotide
gugggaagaaagaugaaguuu

SEQ ID NO: 4423 - DNA, 21 bp, Artificial Sequence
  Synthetic polynucleotide
  modified_base (1)..(1): 5'-monophosphate
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
gugggaagaaagaugaaguuu

SEQ ID NO: 4424 - DNA, 21 bp, Artificial Sequence
  Synthetic polynucleotide
  modified_base (1)..(1): 5'-monophosphate
  modified_base (1)..(21): Positions 2-3, 20-21 phosphorothioate linked nucleoside
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
gugggaagaaagaugaaguuu

SEQ ID NO: 4425 - DNA, 21 bp, Artificial Sequence
  Synthetic polynucleotide
  modified_base (1)..(1): 5'-monophosphate
  modified_base (1)..(21): Positions 1, 3, 5, 7, 9-12, 14, 16, 18, 20 2'-deoxy-2'-fluoro ("2'-fluoro") ribonucleotide
  modified_base (1)..(21): Positions 2, 4, 6, 8, 13, 15, 17, 19, 21 2'-O-methyl ribonucleotide
gugggaagaaagaugaaguuu

SEQ ID NO: 4426 - DNA, 21 bp, Artificial Sequence
  Synthetic polynucleotide
  modified_base (1)..(1): 5'-monophosphate
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
  modified_base (2)..(3): phosphorothioate linked nucleoside
gcagcugcuacugguucucuu

SEQ ID NO: 4427 - DNA, 21 bp, Artificial Sequence
  Synthetic polynucleotide
  modified_base (1)..(1): 5'-monophosphate
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
  modified_base (2)..(3): phosphorothioate linked nucleoside
ugugggaagaaagaugaaguu

SEQ ID NO: 4428 - DNA, 21 bp, Artificial Sequence
  Synthetic polynucleotide
  modified_base (1)..(1): 5'-monophosphate
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (2)..(3): phosphorothioate linked nucleoside
gugggaagaaagaugaaguuu

SEQ ID NO: 4429 - DNA, 21 bp, Artificial Sequence
  Synthetic polynucleotide
  modified_base (1)..(1): 5'-monophosphate
  modified_base (1)..(21): Positions 1, 3, 5, 8-9, 11, 13, 15, 17, 19, 21 2'-deoxy-2'-fluoro ("2'-fluoro") ribonucleotide
  modified_base (1)..(21): Positions 2, 4, 6-7, 10, 12, 14, 16, 18, 20 2'-O-methyl ribonucleotide
  modified_base (2)..(3): phosphorothioate linked nucleoside
gcagcugcuacugguucucuu

SEQ ID NO: 4430 - DNA, 21 bp, Artificial Sequence
  Synthetic polynucleotide
  modified_base (1)..(1): 5'-monophosphate
  modified_base (1)..(21): Positions 1, 3, 5, 7, 9, 11, 13, 15, 17, 19, 21 2'-deoxy-2'-fluoro ("2'-fluoro") ribonucleotide
  modified_base (1)..(21): Positions 2, 4, 6, 8, 10, 12, 14, 16, 18, 20 2'-O-methyl ribonucleotide
  modified_base (2)..(3): phosphorothioate linked nucleoside
gugggaagaaagaugaaguuu

SEQ ID NO: 4431 - DNA, 21 bp, Artificial Sequence
  Synthetic polynucleotide
  modified_base (1)..(1): 5'-monophosphate
  modified_base (1)..(21): Positions 1, 3, 5, 7, 9-10, 13, 15, 17, 19, 21 2'-deoxy-2'-fluoro ("2'-fluoro") ribonucleotide
  modified_base (1)..(21): Positions 2, 4, 6, 8, 10, 13-14, 16, 18, 20 2'-O-methyl ribonucleotide
  modified_base (2)..(3): phosphorothioate linked nucleoside
gugggaagaaagaugaaguuu

SEQ ID NO: 4432 - DNA, 21 bp, Artificial Sequence
  Synthetic polynucleotide
  modified_base (1)..(1): 5'-monophosphate
  modified_base (1)..(21): Positions 1, 3, 6-7, 9, 11, 13, 15, 17, 19, 21 2'-deoxy-2'-fluoro ("2'-fluoro") ribonucleotide
  modified_base (1)..(21): Positions 2, 4-5, 8, 10, 12, 14, 16, 18, 20 2'-O-methyl ribonucleotide
  modified_base (2)..(3): phosphorothioate linked nucleoside
gugggaagaaagaugaaguuu

SEQ ID NO: 4433 - DNA, 21 bp, Artificial Sequence
  Synthetic polynucleotide
  modified_base (1)..(1): 5'-monophosphate
  modified_base (1)..(21): Positions 1, 4-5, 7, 9, 11, 13, 15, 17, 19, 21 2'-deoxy-2'-fluoro ("2'-fluoro") ribonucleotide
  modified_base (1)..(21): Positions 2-3, 6, 8, 10, 12, 14, 16, 18, 20 2'-O-methyl ribonucleotide
  modified_base (2)..(3): phosphorothioate linked nucleoside
gugggaagaaagaugaaguuu

SEQ ID NO: 4434 - DNA, 21 bp, Artificial Sequence
  Synthetic polynucleotide
  modified_base (1)..(1): 5'-monophosphate
  modified_base (1)..(21): Positions 2-3, 5, 7, 9, 11, 13, 15, 17, 19, 21 2'-deoxy-2'-fluoro ("2'-fluoro") ribonucleotide
  modified_base (1)..(21): Positions 1, 4, 6, 8, 10, 12, 14, 16, 18, 20 2'-O-methyl ribonucleotide
  modified_base (2)..(3): phosphorothioate linked nucleoside
gugggaagaaagaugaaguuu

SEQ ID NO: 4435 - DNA, 21 bp, Artificial Sequence
  Synthetic polynucleotide
  modified_base (1)..(21): Positions 1, 3, 5, 7, 9, 11, 13-14, 17, 19, 21 2'-deoxy-2'-fluoro ("2'-fluoro") ribonucleotide
  modified_base (1)..(21): Positions 2, 4, 6, 8, 10, 12, 15-16, 18, 20 2'-O-methyl ribonucleotide
  modified_base (20)..(21): phosphorothioate linked nucleoside
gugggaagaaagaugaaguuu

SEQ ID NO: 4436 - DNA, 21 bp, Artificial Sequence
  Synthetic polynucleotide
  modified_base (1)..(21): Positions 1, 3, 5, 7, 9, 11, 13, 15-16, 19, 21 2'-deoxy-2'-fluoro ("2'-fluoro") ribonucleotide
  modified_base (1)..(21): Positions 2, 4, 6, 8, 10, 12, 14, 17-18, 20 2'-O-methyl ribonucleotide
  modified_base (20)..(21): phosphorothioate linked nucleoside
gugggaagaaagaugaaguuu

SEQ ID NO: 4437 - DNA, 21 bp, Artificial Sequence
  Synthetic polynucleotide
  modified_base (1)..(21): Positions 1, 3, 5, 7, 9, 11, 13, 15, 17-18, 21 2'-deoxy-2'-fluoro ("2'-fluoro") ribonucleotide
  modified_base (1)..(21): Positions 2, 4, 6, 8, 10, 12, 14, 16, 19-20 2'-O-methyl ribonucleotide
  modified_base (20)..(21): phosphorothioate linked nucleoside
gugggaagaaagaugaaguuu

SEQ ID NO: 4438 - DNA, 21 bp, Artificial Sequence
  Synthetic polynucleotide
  modified_base (1)..(21): Positions 2, 4, 6, 8-11, 13, 15, 17, 19, 21 2'-deoxy-2'-fluoro ("2'-fluoro") ribonucleotide
  modified_base (1)..(21): Positions1, 3, 5, 7, 12, 14, 16, 18, 20 2'-O-methyl ribonucleotide
  modified_base (20)..(21): phosphorothioate linked nucleoside
gugggaagaaagaugaaguuu

SEQ ID NO: 4439 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
gugggaagaaagaugaaguuu

SEQ ID NO: 4440 - DNA, 21 bp, Artificial Sequence
  Synthetic polynucleotide
  modified_base (1)..(21): Positions 1, 3, 5, 7, 9-12, 14, 16, 18, 20 2'-deoxy-2'-fluoro ("2'-fluoro") ribonucleotide
  modified_base (1)..(21): Positions 2, 4, 6, 8, 13, 15, 17, 19, 21 2'-O-methyl ribonucleotide
  modified_base (20)..(21): phosphorothioate linked nucleoside
gugggaagaaagaugaaguuu

SEQ ID NO: 4441 - DNA, 21 bp, Artificial Sequence
  Synthetic polynucleotide
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
  modified_base (20)..(21): phosphorothioate linked nucleoside
gcagcugcuacugguucucuu

SEQ ID NO: 4442 - DNA, 21 bp, Artificial Sequence
  Synthetic polynucleotide
  modified_base (1)..(1): 5'-monophosphate
  modified_base (1)..(21): Positions 1, 3, 5, 7, 9, 11, 14-15, 17, 19, 21 2'-deoxy-2'-fluoro ("2'-fluoro") ribonucleotide
  modified_base (1)..(21): Positions 2, 4, 6, 8, 10, 12-13, 16, 18, 20 2'-O-methyl ribonucleotide
  modified_base (2)..(3): phosphorothioate linked nucleoside
gcagcugcuacugguucucuu

SEQ ID NO: 4443 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
gccgcuggaacgacgacguuu

SEQ ID NO: 4444 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
gauagggugauguuccgaauu

SEQ ID NO: 4445 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
ccuaucaugaccaaggaguuu

SEQ ID NO: 4446 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
cuaucaugaccaaggaguauu

SEQ ID NO: 4447 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
aacgggcccuggaaguggguu

SEQ ID NO: 4448 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
gacgggacggacuacgagauu

SEQ ID NO: 4449 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
acgggacggacuacgagacuu

SEQ ID NO: 4450 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
agcagccggacgacugguauu

SEQ ID NO: 4451 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
ccacuucaccgacgacggcuu

SEQ ID NO: 4452 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
cgacggccgcuggaacgacuu

SEQ ID NO: 4453 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
aaacccguggcgcuuucuguu

SEQ ID NO: 4454 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
ccucuucugcuuucucggguu

SEQ ID NO: 4455 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
gaaacccguggcgcuuucuuu

SEQ ID NO: 4456 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
gcagaaauuuguccagcacuu

SEQ ID NO: 4457 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
ggacuacgagacgggcuucuu

SEQ ID NO: 4458 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
gugcccacuucaccgacgauu

SEQ ID NO: 4459 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
guugucugugugaucggauuu

SEQ ID NO: 4460 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
ggucugcgagacagagcuguu

SEQ ID NO: 4461 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
agccaccucuccuuuaauuuu

SEQ ID NO: 4462 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
gcuccacgugaagcaguucuu

SEQ ID NO: 4463 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
gcgcagcugcuacugguucuu

SEQ ID NO: 4464 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
gcugcuacugguucucucguu

SEQ ID NO: 4465 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
acugguucucucgcuccgguu

SEQ ID NO: 4466 - DNA, 21 bp, Artificial Sequence
  Synthetic polynucleotide
  modified_base (1)..(1): 5'-monophosphate
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
gcagcugcuacugguucucuu

SEQ ID NO: 4467 - DNA, 21 bp, Artificial Sequence
  Synthetic polynucleotide
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 4, 6, 8, 14, 16, 18, 20 2'-O-methyl ribonucleotide
  modified_base (2)..(3): phosphorothioate linked nucleoside
gcagcugcuacugguucucuu

SEQ ID NO: 4468 - DNA, 21 bp, Artificial Sequence
  Synthetic polynucleotide
  modified_base (1)..(21): Positions 1, 3, 5, 7, 9-13, 15, 17, 19, 21 2'-deoxy-2'-fluoro ("2'-fluoro") ribonucleotide
  modified_base (1)..(21): Positions 2, 8 2'-O-methyl ribonucleotide
gcagcugcuacugguucucuu

SEQ ID NO: 4469 - DNA, 21 bp, Artificial Sequence
  Synthetic polynucleotide
  modified_base (1)..(1): 5'-monophosphate
  modified_base (1)..(21): Positions 2, 4, 6, 8-9, 11, 13, 15, 17, 19, 21 2'-deoxy-2'-fluoro ("2'-fluoro") ribonucleotide
  modified_base (1)..(21): Positions 1, 3, 5, 7, 10, 12, 14, 16, 18, 20 2'-O-methyl ribonucleotide
  modified_base (2)..(3): phosphorothioate linked nucleoside
gugggaagaaagaugaaguuu

SEQ ID NO: 4470 - DNA, 21 bp, Artificial Sequence
  Synthetic polynucleotide
  modified_base (1)..(21): Positions 2, 4, 6, 8-9, 11, 13, 15, 17, 19, 21 2'-deoxy-2'-fluoro ("2'-fluoro") ribonucleotide
  modified_base (1)..(21): Positions 1, 3, 5, 7, 10, 12, 14, 16, 18, 20 2'-O-methyl ribonucleotide
  modified_base (20)..(21): phosphorothioate linked nucleoside
gugggaagaaagaugaaguuu

SEQ ID NO: 4471 - DNA, 21 bp, Artificial Sequence
  Synthetic polynucleotide
  modified_base (1)..(21): Positions 2, 4, 6, 9, 11, 13, 15, 17, 19, 21 2'-deoxy-2'-fluoro ("2'-fluoro") ribonucleotide
  modified_base (1)..(21): Positions 1, 3, 5, 7-8, 10, 12, 14, 16, 18, 20 2'-O-methyl ribonucleotide
  modified_base (20)..(21): phosphorothioate linked nucleoside
gugggaagaaagaugaaguuu

SEQ ID NO: 4472 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
augggccuccacgaccaaauu

SEQ ID NO: 4473 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
gcacgagcgcagcugcuacuu

SEQ ID NO: 4474 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
uucaccgacgacggccgcuuu

SEQ ID NO: 4475 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
gaaguggguggacgggacguu

SEQ ID NO: 4476 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
ucacguccugggaggagcauu

SEQ ID NO: 4477 - DNA, 22 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (22)..(22): phosphorothioate linked nucleoside
  modified_base (22)..(22): inverted abasic nucleotide attached by 3'-3' linkage
  misc_feature (22)..(22): n is a, c, g, t or u
gugggaagaaagaugaaguuun

SEQ ID NO: 4478 - DNA, 22 bp, Artificial Sequence
  Synthetic polynucleotide
  modified_base (1)..(1): inverted abasic nucleotide attached by 3'-3' linkage
  modified_base (1)..(22): Positions 2, 4, 6, 8, 10-13, 16, 18, 20, 22 2'-deoxy-2'-fluoro ("2'-fluoro") ribonucleotide
  modified_base (1)..(22): Positions 3, 5, 7, 9, 14-15, 17, 19, 21 2'-O-methyl ribonucleotide
  misc_feature (1)..(1): n is a, c, g, t or u
  modified_base (21)..(22): phosphorothioate linked nucleoside
ngugggaagaaagaugaaguuu

SEQ ID NO: 4479 - DNA, 23 bp, Artificial Sequence
  Synthetic polynucleotide
  modified_base (1)..(23): Positions 1, 23 inverted abasic nucleotide attached by 3'-3' linkage
  modified_base (1)..(23): Positions 2, 4, 6, 8, 10-13, 16, 18, 20, 22 2'-deoxy-2'-fluoro ("2'-fluoro") ribonucleotide
  modified_base (1)..(23): Positions 3, 5, 7, 9, 14-15, 17, 19, 21 2'-O-methyl ribonucleotide
  misc_feature (1)..(1): n is a, c, g, t or u
  modified_base (23)..(23): phosphorothioate linked nucleoside
  misc_feature (23)..(23): n is a, c, g, t or u
ngugggaagaaagaugaaguuun

SEQ ID NO: 4480 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (1)..(21): Positions 2-3, 20-21 phosphorothioate linked nucleoside
gugggaagaaagaugaaguuu

SEQ ID NO: 4481 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (1)..(21): Positions 2-4, 20-21 phosphorothioate linked nucleoside
gugggaagaaagaugaaguuu

SEQ ID NO: 4482 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (19)..(21): phosphorothioate linked nucleoside
gugggaagaaagaugaaguuu

SEQ ID NO: 4483 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (21)..(21): phosphorothioate linked nucleoside
gugggaagaaagaugaaguuu

SEQ ID NO: 4484 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
gugggaagaaagaugaaguuu

SEQ ID NO: 4485 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
ccgcuggaacgacgacgucuu

SEQ ID NO: 4486 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
gaugccacguuuggcgugcuu

SEQ ID NO: 4487 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
gagcacccagggaggcaauuu

SEQ ID NO: 4488 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
ggcuugagcacccagggaguu

SEQ ID NO: 4489 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
gaagaaagaugaagucgcuuu

SEQ ID NO: 4490 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
gagaugccacguuuggcguuu

SEQ ID NO: 4491 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
cgggacggacuacgagacguu

SEQ ID NO: 4492 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
cuacgagacgggcuucaaguu

SEQ ID NO: 4493 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
cccgggcacuggagaugccuu

SEQ ID NO: 4494 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
ugaaacccguggcgcuuucuu

SEQ ID NO: 4495 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
gguggucacguccugggaguu

SEQ ID NO: 4496 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
cagaaauuuguccagcaccuu

SEQ ID NO: 4497 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
augccacguuuggcgugcuuu

SEQ ID NO: 4498 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
agcugcggggccugagagauu

SEQ ID NO: 4499 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
gcccuaucaugaccaaggauu

SEQ ID NO: 4500 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
agcaacuucacagcgagcauu

SEQ ID NO: 4501 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
agcagaaauuuguccagcauu

SEQ ID NO: 4502 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
aaaacgggcccuggaaguguu

SEQ ID NO: 4503 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
gccugagcugucagauggcuu

SEQ ID NO: 4504 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleo
uggagaugccacguuuggcuu

SEQ ID NO: 4505 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
acuacgagacgggcuucaauu

SEQ ID NO: 4506 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
aaguggguggacgggacgguu

SEQ ID NO: 4507 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
ugcacagcacugaagaaccuu

SEQ ID NO: 4508 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
acggacuacgagacgggcuuu

SEQ ID NO: 4509 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
ggacgacugguacggccacuu

SEQ ID NO: 4510 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
gagcugcggggccugagaguu

SEQ ID NO: 4511 - DNA, 21 bp, Artificial Sequence
  Synthetic polynucleotide
  modified_base (1)..(21): Positions 1, 3, 5, 7, 9-12, 15, 17, 19, 21 2'-deoxy-2'-fluoro ("2'-fluoro") ribonucleotide
  modified_base (1)..(21): Positions 2, 4, 6, 8, 13-14, 16, 18, 20 2'-O-methyl ribonucleotide
  modified_base (20)..(21): phosphorothioate linked nucleoside
cacguuuggcgugcuuggauu

SEQ ID NO: 4512 - DNA, 21 bp, Artificial Sequence
  Synthetic polynucleotide
  modified_base (1)..(21): Positions 1, 3, 5, 8-11, 13, 15, 17, 19, 21 2'-deoxy-2'-fluoro ("2'-fluoro") ribonucleotide
  modified_base (1)..(21): Positions 2, 4, 6-7, 12, 14, 16, 18, 20 2'-O-methyl ribonucleotide
  modified_base (20)..(21): phosphorothioate linked nucleoside
gugggaagaaagaugaaguuu

SEQ ID NO: 4513 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (1)..(21): Positions 2-3, 20-21 phosphorothioate linked nucleoside
acuucaucuuucuucccacuu

SEQ ID NO: 4514 - DNA, 21 bp, Artificial Sequence
  Synthetic polynucleotide
  modified_base (1)..(1): 5'-monophosphate
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (1)..(21): Positions 2-3, 20-21 phosphorothioate linked nucleoside
acuucaucuuucuucccacuu

SEQ ID NO: 4515 - DNA, 21 bp, Artificial Sequence
  Synthetic polynucleotide
  modified_base (1)..(1): 5'-monophosphate
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (1)..(21): Positions 2-3, 20-21 phosphorothioate linked nucleoside
acuucaucuuucuucccacuu

SEQ ID NO: 4516 - DNA, 21 bp, Artificial Sequence
  Synthetic polynucleotide
  modified_base (1)..(1): 5'-monophosphate
  modified_base (1)..(21): Positions 2, 4, 6, 8, 10, 12, 14, 16 2'-deoxy-2'-fluoro ("2'-fluoro") ribonucleotide
  modified_base (1)..(21): Positions 1, 3, 5, 7, 9, 11, 13, 15, 17-21 2'-O-methyl ribonucleotide
  modified_base (1)..(21): Positions 2-3, 20-21 phosphorothioate linked nucleoside
acuucaucuuucuucccacuu

SEQ ID NO: 4517 - DNA, 22 bp, Artificial Sequence
  Synthetic polynucleotide
  modified_base (1)..(1): 5'-monophosphate
  modified_base (1)..(21): Positions 2, 4, 6, 8, 10, 12, 14, 16, 18, 20 2'-deoxy-2'-fluoro ("2'-fluoro") ribonucleotide
  modified_base (1)..(21): Positions1, 3, 5, 7, 9, 11, 13, 15, 17, 19, 21 2'-O-methyl ribonucleotide
  modified_base (1)..(21): Positions 2-3, 20-21 phosphorothioate linked nucleoside
gsagaaccaguagcagcugcuu

SEQ ID NO: 4518 - DNA, 21 bp, Artificial Sequence
  Synthetic polynucleotide
  modified_base (1)..(1): 5'-monophosphate
  modified_base (1)..(21): Positions 2, 4, 6, 8, 13-14, 16, 18, 20 2'-deoxy-2'-fluoro ("2'-fluoro") ribonucleotide
  modified_base (1)..(21): Positions 1, 3, 5, 7, 9-12, 15, 17, 19, 21 2'-O-methyl ribonucleotide
  modified_base (1)..(21): Positions 2-3, 20-21 phosphorothioate linked nucleoside
gagaaccaguagcagcugcuu

SEQ ID NO: 4519 - DNA, 21 bp, Artificial Sequence
  Synthetic polynucleotide
  modified_base (1)..(1): 5'-monophosphate
  modified_base (1)..(21): Positions 2, 4, 6, 8, 13, 15, 17, 19, 21 2'-deoxy-2'-fluoro ("2'-fluoro") ribonucleotide
  modified_base (1)..(21): Positions 1, 3, 5, 7, 9-12, 14, 16, 18, 20 2'-O-methyl ribonucleotide
  modified_base (1)..(21): Positions 2-3, 20-21 phosphorothioate linked nucleoside
gagaaccaguagcagcugcuu

SEQ ID NO: 4520 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
gagaaccaguagcagcugcuu

SEQ ID NO: 4521 - DNA, 21 bp, Artificial Sequence
  Synthetic polynucleotide
  modified_base (1)..(1): 5'-monophosphate
  modified_base (1)..(21): Positions 1, 3, 5, 7, 12, 14, 16, 18, 20 2'-deoxy-2'-fluoro ("2'-fluoro") ribonucleotide
  modified_base (1)..(21): Positions 2, 4, 6, 8-11, 13, 15, 17, 19, 21 2'-O-methyl ribonucleotide
  modified_base (1)..(21): Positions 2-3, 20-21 phosphorothioate linked nucleoside
gagaaccaguagcagcugcuu

SEQ ID NO: 4522 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (1)..(21): Positions 2-3, 20-21 phosphorothioate linked nucleoside
gagaaccaguagcagcugcuu

SEQ ID NO: 4523 - DNA, 21 bp, Artificial Sequence
  Synthetic polynucleotide
  modified_base (1)..(1): 5'-monophosphate
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (1)..(21): Positions 2-3, 20-21 phosphorothioate linked nucleoside
gagaaccaguagcagcugcuu

SEQ ID NO: 4524 - DNA, 21 bp, Artificial Sequence
  Synthetic polynucleotide
  modified_base (1)..(1): 5'-monophosphate
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
  modified_base (1)..(21): Positions 2-3, 20-21 phosphorothioate linked nucleoside
gagaaccaguagcagcugcuu

SEQ ID NO: 4525 - DNA, 21 bp, Artificial Sequence
  Synthetic polynucleotide
  modified_base (1)..(1): 5'-monophosphate
  modified_base (1)..(21): Positions 2, 4, 6, 8, 10, 12, 14, 16 2'-deoxy-2'-fluoro ("2'-fluoro") ribonucleotide
  modified_base (1)..(21): Positions 1, 3, 5, 7, 9, 11, 13, 15, 17-21 2'-O-methyl ribonucleotide
  modified_base (1)..(21): Positions 2-3, 20-21 phosphorothioate linked nucleoside
gagaaccaguagcagcugcuu

SEQ ID NO: 4526 - DNA, 21 bp, Artificial Sequence
  Synthetic polynucleotide
  modified_base (1)..(1): 5'-monophosphate
  modified_base (1)..(21): Positions 2, 4, 6, 8, 10, 12, 14, 16, 18, 20 2'-deoxy-2'-fluoro ("2'-fluoro") ribonucleotide
  modified_base (1)..(21): Positions 1, 3, 5, 7, 9, 11, 13, 15, 17, 19, 21
  modified_base (1)..(21): Positions 2-3, 20-21
cuucaucuuucuucccacauu

SEQ ID NO: 4527 - DNA, 23 bp, Artificial Sequence
  Synthetic polynucleotide
  modified_base (1)..(1): 5'-monophosphate
  modified_base (1)..(21): Positions 2, 4, 6, 8, 13-14, 16, 18, 20 2'-deoxy-2'-fluoro ("2'-fluoro") ribonucleotide
  modified_base (1)..(21): Positions 1, 3, 5, 7, 9-12, 15, 17, 19, 21 2'-O-methyl ribonucleotide
  modified_base (1)..(21): Positions 2-3, 20-21 phosphorothioate linked nucleoside
cuucaucuuucuucccacasusu

SEQ ID NO: 4528 - DNA, 21 bp, Artificial Sequence
  Synthetic polynucleotide
  modified_base (1)..(1): 5'-monophosphate
  modified_base (1)..(21): Positions 1, 3, 5, 7, 9, 11, 13, 15 2'-deoxy-2'-fluoro ("2'-fluoro") ribonucleotide
  modified_base (1)..(21): Positions 1, 3, 5, 7, 9, 11, 13, 15, 17-21 2'-O-methyl ribonucleotide
cuucaucuuucuucccacauu

SEQ ID NO: 4529 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (1)..(21): Positions 2-3, 20-21 phosphorothioate linked nucleoside
cuucaucuuucuucccacauu

SEQ ID NO: 4530 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
acuucaucuuucuucccacuu

SEQ ID NO: 4531 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
gagaaccaguagcagcugcuu

SEQ ID NO: 4532 - DNA, 21 bp, Artificial Sequence
  Synthetic polynucleotide
  modified_base (1)..(1): 5'-monophosphate
  modified_base (1)..(1): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
cuucaucuuucuucccacauu

SEQ ID NO: 4533 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
gugaagugggcacaguccuuu

SEQ ID NO: 4534 - DNA, 21 bp, Artificial Sequence
  Synthetic polynucleotide
  modified_base (1)..(1): 5'-monophosphate
  modified_base (1)..(21): Positions 2, 4, 6, 8, 10, 12, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
aguucuugaagcccgucucuu

SEQ ID NO: 4535 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
accaguagcagcugcgcucuu

SEQ ID NO: 4536 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
auccgaucacacagacaacuu

SEQ ID NO: 4537 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
ucucaggccccgcagcuccuu

SEQ ID NO: 4538 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
acgucgucguuccagcggcuu

SEQ ID NO: 4539 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
ucugucucgcagacccagcuu

SEQ ID NO: 4540 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
ugaaaauucccgagaaagcuu

SEQ ID NO: 4541 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
aaccacaagcagcaggagguu

SEQ ID NO: 4542 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribon
uacuccuuggucaugauaguu

SEQ ID NO: 4543 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
uucugcuccucccaggacguu

SEQ ID NO: 4544 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
aagcagaagaggcccccaguu

SEQ ID NO: 4545 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
acuccuuggucaugauagguu

SEQ ID NO: 4546 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
uucggaacaucacccuaucuu

SEQ ID NO: 4547 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
augauaaccugcaaacugcuu

SEQ ID NO: 4548 - DNA, 23 bp, Artificial Sequence
  Synthetic polynucleotide
  modified_base (1)..(1): 5'-monophosphate
  modified_base (1)..(21): Positions 2, 4, 6, 8, 10, 14, 16, 18, 20 2'-deoxy-2'-fluoro ("2'-fluoro") ribonucleotide
  modified_base (1)..(21): Positions 1, 3, 5, 7, 9, 11-13, 15, 17, 19, 21 2'-O-methyl ribonucleotide
  modified_base (1)..(21): Positions 2-3, 20-21 phosphorothioate linked nucleoside
cgacuucaucuuucuucccacuu

SEQ ID NO: 4549 - DNA, 23 bp, Artificial Sequence
  Synthetic polynucleotide
  modified_base (1)..(1): 5'-monophosphate
  modified_base (1)..(23): Positions 2, 4, 6, 8, 10, 14, 16, 18, 22 2'-deoxy-2'-fluoro ("2'-fluoro") ribonucleotide
  modified_base (1)..(23): Positions 1, 3, 5, 7, 9, 11-13, 15, 17, 19, 21, 23 2'-O-methyl ribonucleotide
  modified_base (1)..(23): Positions 2-3, 22-23 phosphorothioate linked nucleoside
gagagaaccaguagcagcugcuu

SEQ ID NO: 4550 - DNA, 23 bp, Artificial Sequence
  Synthetic polynucleotide
  modified_base (1)..(1): 5'-monophosphate
  modified_base (1)..(23): Positions 2, 4, 6, 8, 10, 14, 16, 18, 20, 22 2'-deoxy-2'-fluoro ("2'-fluoro") ribonucleotide
  modified_base (1)..(23): Positions 1, 3, 5, 7, 9, 11-13, 15, 17, 19, 21, 23 2'-O-methyl ribonucleotide
  modified_base (1)..(23): Positions 2-3, 22-23 phosphorothioate linked nucleoside
gacuucaucuuucuucccacauu

SEQ ID NO: 4551 - DNA, 23 bp, Artificial Sequence
  Synthetic polynucleotide
  modified_base (1)..(1): 5'-monophosphate
  modified_base (1)..(23): Positions 2, 4, 6, 8, 10, 14, 16, 18, 20, 22 2'-deoxy-2'-fluoro ("2'-fluoro") ribonucleotide
  modified_base (1)..(23): Positions 1, 3, 5, 7, 9, 11-13, 15, 17, 19, 21, 23 2'-O-methyl ribonucleotide
  modified_base (1)..(23): Positions 2-3, 22-23 phosphorothioate linked nucleoside
acuucaucuuucuucccacauuu

SEQ ID NO: 4552 - DNA, 23 bp, Artificial Sequence
  Synthetic polynucleotide
  modified_base (1)..(1): 5'-monophosphate
  modified_base (1)..(23): Positions 2, 4, 6, 8, 10, 14, 16, 18, 20, 23 2'-deoxy-2'-fluoro ("2'-fluoro") ribonucleotide
  modified_base (1)..(23): Positions 1, 3, 5, 7, 9, 11-13, 15, 17, 19, 21, 23 2'-O-methyl ribonucleotide
  modified_base (1)..(23): Positions 2-3, 22-23 phosphorothioate linked nucleoside
gagaaccaguagcagcugcgcuu

SEQ ID NO: 4553 - DNA, 23 bp, Artificial Sequence
  Synthetic polynucleotide
  modified_base (1)..(1): 5'-monophosphate
  modified_base (1)..(23): Positions 2, 4, 6, 8, 10, 14, 16, 18, 20, 22 2'-deoxy-2'-fluoro ("2'-fluoro") ribonucleotide
  modified_base (1)..(23): Positions 1, 3, 5, 7, 9, 11-13, 15, 17, 19, 21, 23 2'-O-methyl ribonucleotide
  modified_base (1)..(23): Positions 2-3, 22-23 phosphorothioate linked nucleoside
cuucaucuuucuucccacauuuu

SEQ ID NO: 4554 - DNA, 21 bp, Artificial Sequence
  Synthetic polynucleotide
  modified_base (1)..(1): 5'-monophosphate
  modified_base (1)..(21): Positions 1, 3, 5, 7-11, 13, 15, 17, 19, 21 2'-O-methyl ribonucleotide
  modified_base (1)..(21): Positions 2, 4, 6, 8, 12, 14, 16, 18, 20 2'-deoxy-2'-fluoro ("2'-fluoro") ribonucleotide
  modified_base (1)..(21): Positions 2-3, 20-21 phosphorothioate linked nucleoside
ucucguaguccgucccgucuu

SEQ ID NO: 4555 - DNA, 21 bp, Artificial Sequence
  Synthetic polynucleotide
  modified_base (1)..(1): 5'-monophosphate
  modified_base (1)..(21): Positions 2, 4, 6, 8, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (1)..(21): Positions 2-3, 20-21 phosphorothioate linked nucleoside
aauuaaaggagagguggcuuu

SEQ ID NO: 4556 - DNA, 21 bp, Artificial Sequence
  Synthetic polynucleotide
  modified_base (1)..(1): 5'-monophosphate
  modified_base (1)..(21): Positions 2, 4, 6, 8, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (1)..(21): Positions 2-3, 20-21 phosphorothioate linked nucleoside
gcucaggcuccgcaggucauu

SEQ ID NO: 4557 - DNA, 21 bp, Artificial Sequence
  Synthetic polynucleotide
  modified_base (1)..(1): 5'-monophosphate
  modified_base (1)..(21): Positions 2, 4, 6,12, 14, 16, 18, 20-21 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (1)..(21): Positions 2-3, 20-21 phosphorothioate linked nucleoside
gaggcccagggagagcagguu

SEQ ID NO: 4558 - DNA, 21 bp, Artificial Sequence
  Synthetic polynucleotide
  modified_base (1)..(1): 5'-monophosphate
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (1)..(21): Positions 2-3, 20-21 phosphorothioate linked nucleoside
gcccagggagagcaggagguu

SEQ ID NO: 4559 - DNA, 21 bp, Artificial Sequence
  Synthetic polynucleotide
  modified_base (1)..(1): 5'-monophosphate
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (1)..(21): Positions 2-3, 20-21 phosphorothioate linked nucleoside
cgagagaaccaguagcagcuu

SEQ ID NO: 4560 - DNA, 21 bp, Artificial Sequence
  Synthetic polynucleotide
  modified_base (1)..(1): 5'-monophosphate
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (1)..(21): Positions 2-3, 20-21 phosphorothioate linked nucleoside
cugaagcuuggagaauggguu

SEQ ID NO: 4561 - DNA, 21 bp, Artificial Sequence
  Synthetic polynucleotide
  modified_base (1)..(1): 5'-monophosphate
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (1)..(21): Positions 2-3, 20-21 phosphorothioate linked nucleoside
ccggagcgagagaaccaguuu

SEQ ID NO: 4562 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (1)..(21): Positions 2-3, 20-21 phosphorothioate linked nucleoside
ucucguaguccgucccgucuu

SEQ ID NO: 4563 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (1)..(21): Positions 2-3, 20-21 phosphorothioate linked nucleoside
aauuaaaggagagguggcuuu

SEQ ID NO: 4564 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (1)..(21): Positions 2-3, 20-21 phosphorothioate linked nucleoside
guagcagcugcgcucgugcuu

SEQ ID NO: 4565 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (1)..(21): Positions 2-3, 20-21 phosphorothioate linked nucleoside
gaaccaguagcagcugcgcuu

SEQ ID NO: 4566 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (1)..(21): Positions 2-3, 20-21 phosphorothioate linked nucleoside
gucucguaguccgucccguuu

SEQ ID NO: 4567 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (1)..(21): Positions 2-3, 20-21 phosphorothioate linked nucleoside
gaacugcuucacguggagcuu

SEQ ID NO: 4568 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (1)..(21): Positions 2-3, 20-21 phosphorothioate linked nucleoside
gcucaggcuccgcaggucauu

SEQ ID NO: 4569 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9,-13, 15, 17, 19, 21 2'-O-methyl ribonucleotide
  modified_base (1)..(21): Positions 2-3, 20-21 phosphorothioate linked nuc
cucucucaggccccgcagcuu

SEQ ID NO: 4570 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (1)..(21): Positions 2-3, 20-21 phosphorothioate linked nucleoside
agcggccgucgucggugaauu

SEQ ID NO: 4571 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (1)..(21): Positions 2-3, 20-21 phosphorothioate linked nucleoside
gggcccguuuuggucgugguu

SEQ ID NO: 4572 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (1)..(21): Positions 2-3, 20-21 phosphorothioate linked nucleoside
gaggcccagggagagcagguu

SEQ ID NO: 4573 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (1)..(21): Positions 2-3, 20-21 phosphorothioate linked nucleoside
gcccagggagagcaggagguu

SEQ ID NO: 4574 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (1)..(21): Positions 2-3, 20-21 phosphorothioate linked nucleoside
cgacuucaucuuucuucccuu

SEQ ID NO: 4575 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (1)..(21): Positions 2-3, 20-21 phosphorothioate linked nucleoside
gccgucgucggugaagugguu

SEQ ID NO: 4576 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (1)..(21): Positions 2-3, 20-21 phosphorothioate linked nucleoside
cgagagaaccaguagcagcuu

SEQ ID NO: 4577 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (1)..(21): Positions 2-3, 20-21 phosphorothioate linked nucleoside
cccacuuccagggcccguuuu

SEQ ID NO: 4578 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (1)..(21): Positions 2-3, 20-21 phosphorothioate linked nucleoside
uaccagucguccggcugcuuu

SEQ ID NO: 4579 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (1)..(21): Positions 2-3, 20-21 phosphorothioate linked nucleoside
guccagcucugucucgcaguu

SEQ ID NO: 4580 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (1)..(21): Positions 2-3, 20-21 phosphorothioate linked nucleoside
caccaggugcgcguccuccuu

SEQ ID NO: 4581 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (1)..(21): Positions 2-3, 20-21 phosphorothioate linked nucleoside
ugcuccucccaggacgugauu

SEQ ID NO: 4582 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (1)..(21): Positions 2-3, 20-21 phosphorothioate linked nucleoside
gaccgggcagcagguccuuuu

SEQ ID NO: 4583 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (1)..(21): Positions 2-3, 20-21 phosphorothioate linked nucleoside
cugaagcuuggagaauggguu

SEQ ID NO: 4584 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (1)..(21): Positions 2-3, 20-21 phosphorothioate linked nucleoside
uuuggucguggaggcccauuu

SEQ ID NO: 4585 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (1)..(21): Positions 2-3, 20-21 phosphorothioate linked nucleoside
gucguuccagcggccgucguu

SEQ ID NO: 4586 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (1)..(21): Positions 2-3, 20-21 phosphorothioate linked nucleoside
ccggagcgagagaaccaguuu

SEQ ID NO: 4587 - DNA, 21 bp, Artificial Sequence
  Synthetic polynucleotide
  modified_base (1)..(1): 5'-monophosphate
  modified_base (1)..(1): Positions 2, 4, 6, 8, 14, 16, 18, 20 2'-deoxy-2'-fluoro ("2'-fluoro") ribonucleotide
  modified_base (1)..(1): Positions 1, 3, 5, 7, 9-13, 15, 17, 19, 21 2'-O-methyl ribonucleotide
  modified_base (1)..(1): Positions 2-3, 20-21 phosphorothioate linked nucleoside
ccagggcccguuuuggucguu

SEQ ID NO: 4588 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
  modified_base (1)..(21): Positions 2-3, 20-21 phosphorothioate linked nucleoside
cagcucugucucgcagaccuu

SEQ ID NO: 4589 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
ucucguaguccgucccgucuu

SEQ ID NO: 4590 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
aauuaaaggagagguggcuuu

SEQ ID NO: 4591 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
gcucaggcuccgcaggucauu

SEQ ID NO: 4592 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
gaggcccagggagagcagguu

SEQ ID NO: 4593 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
gcccagggagagcaggagguu

SEQ ID NO: 4594 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
cgagagaaccaguagcagcuu

SEQ ID NO: 4595 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
cugaagcuuggagaauggguu

SEQ ID NO: 4596 - DNA, 21 bp, Artificial Sequence
  Synthetic polynucleotide
  modified_base (1)..(1): 5'-monophosphate
  modified_base (1)..(21): Positions 2, 4, 6, 8, 14, 16, 18, 20 2'-deoxy-2'-fluoro ("2'-fluoro") ribonucleotide
  modified_base (1)..(21): Positions 1, 3, 5, 7, 9-13, 15, 17, 19, 21 2'-O-methyl ribonucleotide
ccggagcgagagaaccaguuu

SEQ ID NO: 4597 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
acuucaucuuucuucccacuu

SEQ ID NO: 4598 - DNA, 21 bp, Artificial Sequence
  Synthetic polynucleotide
  modified_base (1)..(1): 5'-monophosphate
  modified_base (1)..(21): Positions 2, 4, 6, 8, 10, 13-14, 16, 18, 20 2'-deoxy-2'-fluoro ("2'-fluoro") ribonucleotide
  modified_base (1)..(21): Positions 1, 3, 5, 7, 9, 11-12, 15, 17, 19, 21 2'-O-methyl ribonucleotide
acuucaucuuucuucccacuu

SEQ ID NO: 4599 - DNA, 21 bp, Artificial Sequence
  Synthetic polynucleotide
  modified_base (1)..(1): 5'-monophosphate
  modified_base (1)..(21): Positions 2, 4, 6-7, 10, 12, 14, 16, 18, 20 2'-deoxy-2'-fluoro ("2'-fluoro") ribonucleotide
  modified_base (1)..(21): Positions 1, 3, 5, 8-9, 11, 13, 15, 17, 19, 21 2'-O-methyl ribonucleotide
  modified_base (1)..(21): Positions 2-3, 20-21 phosphorothioate linked nucleoside
acuucaucuuucuucccacuu

SEQ ID NO: 4600 - DNA, 21 bp, Artificial Sequence
  Synthetic polynucleotide
  modified_base (1)..(1): 5'-monophosphate
  modified_base (1)..(21): Positions 2, 4, 6, 8, 12, 14, 16, 18, 20 2'-deoxy-2'-fluoro ("2'-fluoro") ribonucleotide
  modified_base (1)..(21): Positions 1, 3, 5, 7, 9-11, 13, 15, 17, 19, 21 2'-O-methyl ribonucleotide
  modified_base (1)..(21): Positions 2-3, 20-21 phosphorothioate linked nucleoside
acuucaucuuucuucccacuu

SEQ ID NO: 4601 - DNA, 21 bp, Artificial Sequence
  Synthetic polynucleotide
  modified_base (1)..(1): 5'-monophosphate
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
acuucaucuuucuucccacuu

SEQ ID NO: 4602 - DNA, 21 bp, Artificial Sequence
  Synthetic polynucleotide
  modified_base (1)..(1): 5'-monophosphate
  modified_base (1)..(21): Positions 1-2, 4, 6, 8, 10, 12, 14, 16, 18, 20 2'-deoxy-2'-fluoro ("2'-fluoro") ribonucleotide
  modified_base (1)..(21): Positions 3, 5, 7, 9, 11, 13, 15, 17, 19, 21 2'-O-methyl ribonucleotide
acuucaucuuucuucccacuu

SEQ ID NO: 4603 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
acuucaucuuucuucccacuu

SEQ ID NO: 4604 - DNA, 21 bp, Artificial Sequence
  Synthetic polynucleotide
  modified_base (1)..(1): 5'-monophosphate
  modified_base (1)..(21): Positions 1, 3, 5, 7, 12, 14, 16, 18, 20 2'-deoxy-2'-fluoro ("2'-fluoro") ribonucleotide
  modified_base (1)..(21): Positions 2, 4, 6, 8-11, 13, 15, 17, 19, 21 2'-O-methyl ribonucleotide
acuucaucuuucuucccacuu

SEQ ID NO: 4605 - DNA, 21 bp, Artificial Sequence
  Synthetic polynucleotide
  modified_base (1)..(1): 5'-monophosphate
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (1)..(21): Positions 2-3, 20-21 phosphorothioate linked nucleoside
cuucaucuuucuucccacauu

SEQ ID NO: 4606 - DNA, 21 bp, Artificial Sequence
  Synthetic polynucleotide
  modified_base (1)..(1): 5'-monophosphate
  modified_base (1)..(21): Positions 2, 4, 6, 8, 10, 12, 14, 16, 18, 20-21 2'-deoxy-2'-fluoro ("2'-fluoro") ribonucleotide
  modified_base (1)..(21): Positions 1, 3, 5, 7, 9, 11, 13, 15, 17, 19 2'-O-methyl ribonucleotide
  modified_base (1)..(21): Positions 2-3, 20-21 phosphorothioate linked nucleoside
acuucaucuuucuucccacuu

SEQ ID NO: 4607 - DNA, 21 bp, Artificial Sequence
  Synthetic polynucleotide
  modified_base (1)..(1): 5'-monophosphate
  modified_base (1)..(21): Positions 2, 4, 6, 8, 10, 12, 15-16, 18, 20 2'-deoxy-2'-fluoro ("2'-fluoro") ribonucleotide
  modified_base (1)..(21): Positions 1, 3, 5, 7, 9, 11, 13-14, 17, 19, 21 2'-O-methyl ribonucleotide
  modified_base (1)..(21): Positions 2-3, 20-21 phosphorothioate linked nucleoside
acuucaucuuucuucccacuu

SEQ ID NO: 4608 - DNA, 21 bp, Artificial Sequence
  Synthetic polynucleotide
  modified_base (1)..(1): 5'-monophosphate
  modified_base (1)..(21): Positions 2, 4, 6, 8, 10, 12, 14, 17-18, 20 2'-deoxy-2'-fluoro ("2'-fluoro") ribonucleotide
  modified_base (1)..(21): Positions 1, 3, 5, 7, 9, 11, 13, 15-16, 19, 21 2'-O-methyl ribonucleotide
  modified_base (1)..(21): Positions 2-3, 20-21 phosphorothioate linked nucleoside
acuucaucuuucuucccacuu

SEQ ID NO: 4609 - DNA, 21 bp, Artificial Sequence
  Synthetic polynucleotide
  modified_base (1)..(1): 5'-monophosphate
  modified_base (1)..(21): Positions 2, 4, 6, 8, 10, 12, 14, 16, 19-21 2'-deoxy-2'-fluoro ("2'-fluoro") ribonucleotide
  modified_base (1)..(21): Positions 1, 3, 5, 7, 9, 11, 13, 15, 17-18 2'-O-methyl ribonucleotide
  modified_base (1)..(21): Positions 2-3, 20-21 phosphorothioate linked nucleoside
acuucaucuuucuucccacuu

SEQ ID NO: 4610 - DNA, 21 bp, Artificial Sequence
  Synthetic polynucleotide
  modified_base (1)..(1): 5'-monophosphate
  modified_base (1)..(21): Positions 2, 4-5, 8, 10, 12, 14, 16, 18, 20 2'-deoxy-2'-fluoro ("2'-fluoro") ribonucleotide
  modified_base (1)..(21): Positions 1, 3, 6-7, 9, 11, 13, 15, 17, 19, 21 2'-O-methyl ribonucleotide
  modified_base (1)..(21): Positions 2-3, 20-21 phosphorothioate linked nucleoside
acuucaucuuucuucccacuu

SEQ ID NO: 4611 - DNA, 21 bp, Artificial Sequence
  Synthetic polynucleotide
  modified_base (1)..(1): 5'-monophosphate
  modified_base (1)..(21): Positions 2-3, 6, 8, 10, 12, 14, 16, 18, 20 2'-deoxy-2'-fluoro ("2'-fluoro") ribonucleotide
  modified_base (1)..(21): Positions 1, 4-5, 7, 9, 11, 13, 15, 17, 19, 21 2'-O-methyl ribonucleotide
  modified_base (1)..(21): Positions 2-3, 20-21 phosphorothioate linked nucleoside
acuucaucuuucuucccacuu

SEQ ID NO: 4612 - DNA, 21 bp, Artificial Sequence
  Synthetic polynucleotide
  modified_base (1)..(1): 5'-monophosphate
  modified_base (1)..(21): Positions 1, 4, 6, 8, 10, 12, 14, 16, 18, 20 2'-deoxy-2'-fluoro ("2'-fluoro") ribonucleotide
  modified_base (1)..(21): Positions 2-3, 5, 7, 9, 11, 13, 15, 17, 19, 21 2'-O-methyl ribonucleotide
  modified_base (1)..(21): Positions 2-3, 20-21 phosphorothioate linked nucleoside
acuucaucuuucuucccacuu

SEQ ID NO: 4613 - DNA, 21 bp, Artificial Sequence
  Synthetic polynucleotide
  modified_base (1)..(1): 5'-monophosphate
  modified_base (1)..(21): Positions 2, 4, 6, 8, 13, 15, 17, 19, 21 2'-deoxy-2'-fluoro ("2'-fluoro") ribonucleotide
  modified_base (1)..(21): Positions 1, 3, 5, 7, 9-12, 14, 16, 18, 20 2'-O-methyl ribonucleotide
  modified_base (1)..(21): Positions 2-3, 20-21 phosphorothioate linked nucleoside
acuucaucuuucuucccacuu

SEQ ID NO: 4614 - DNA, 21 bp, Artificial Sequence
  Synthetic polynucleotide
  modified_base (1)..(1): 5'-monophosphate
  modified_base (1)..(21): Positions 1, 3, 5, 7, 12, 14, 16, 18, 20 2'-deoxy-2'-fluoro ("2'-fluoro") ribonucleotide
  modified_base (1)..(21): Positions 2, 4, 6, 8-11, 13, 15, 17, 19, 21 2'-O-methyl ribonucleotide
  modified_base (1)..(21): Positions 2-3, 20-21 phosphorothioate linked nucleoside
acuucaucuuucuucccacuu

SEQ ID NO: 4615 - DNA, 21 bp, Artificial Sequence
  Synthetic polynucleotide
  modified_base (1)..(1): 5'-monophosphate
  modified_base (1)..(21): Positions 2, 4, 6, 8, 10, 13-14, 16, 18, 20-21 2'-deoxy-2'-fluoro ("2'-fluoro") ribonucleotide
  modified_base (1)..(21): Positions 1, 3, 5, 7, 9, 11-12, 15, 17, 19 2'-O-methyl ribonucleotide
  modified_base (1)..(21): Positions 2-3, 20-21 phosphorothioate linked nucleoside
gagaaccaguagcagcugcuu

SEQ ID NO: 4616 - DNA, 21 bp, Artificial Sequence
  Synthetic polynucleotide
  modified_base (1)..(1): 5'-monophosphate
  modified_base (1)..(21): Positions 2, 4, 6, 12, 14, 16, 18, 20-21 2'-deoxy-2'-fluoro ("2'-fluoro") ribonucleotide
  modified_base (1)..(21): Positions 1, 3, 5, 7-11, 13, 15, 17, 19 2'-O-methyl ribonucleotide
  modified_base (1)..(21): Positions 2-3, 20-21 phosphorothioate linked nucleoside
gagaaccaguagcagcugcuu

SEQ ID NO: 4617 - DNA, 21 bp, Artificial Sequence
  Synthetic polynucleotide
  modified_base (1)..(1): 5'-monophosphate
  modified_base (1)..(21): Positions 2, 4, 7-8, 10, 12, 14, 16, 18, 20 2'-deoxy-2'-fluoro ("2'-fluoro") ribonucleotide
  modified_base (1)..(21): Positions 1, 3, 5-6, 9, 11, 13, 15, 17, 19, 21 2'-O-methyl ribonucleotide
  modified_base (1)..(21): Positions 2-3, 20-21 phosphorothioate linked nucleoside
gagaaccaguagcagcugcuu

SEQ ID NO: 4618 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
acgucgucguuccagcggcuu

SEQ ID NO: 4619 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
uucggaacaucacccuaucuu

SEQ ID NO: 4620 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
acuccuuggucaugauagguu

SEQ ID NO: 4621 - DNA, 21 bp, Artificial Sequence
  Synthetic polynucleotide
  modified_base (1)..(1): 5'-monophosphate
  modified_base (1)..(21): Positions 2, 4, 6-7,  12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
uacuccuuggucaugauaguu

SEQ ID NO: 4622 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
cccacuuccagggcccguuuu

SEQ ID NO: 4623 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
ucucguaguccgucccgucuu

SEQ ID NO: 4624 - DNA, 21 bp, Artificial Sequence
  Synthetic polynucleotide
  modified_base (1)..(1): 5'-monophosphate
  modified_base (1)..(21): Positions 2, 4, 6-7,  12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
gucucguaguccgucccguuu

SEQ ID NO: 4625 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
uaccagucguccggcugcuuu

SEQ ID NO: 4626 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
gccgucgucggugaagugguu

SEQ ID NO: 4627 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
gucguuccagcggccgucguu

SEQ ID NO: 4628 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
cagaaagcgccacggguuuuu

SEQ ID NO: 4629 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
cccgagaaagcagaagagguu

SEQ ID NO: 4630 - DNA, 21 bp, Artificial Sequence
  Synthetic polynucleotide
  modified_base (1)..(1): 5'-monophosphate
  modified_base (1)..(21): Positions 2, 4, 6,-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
agaaagcgccacggguuucuu

SEQ ID NO: 4631 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
gugcuggacaaauuucugcuu

SEQ ID NO: 4632 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 7, 9, 11, 13, 15, 17, 19, 21 2'-O-methyl ribonucleotide
  modified_base (1)..(21): Positions 2-3, 20-21 phosphorothioate linked nucleoside
gaagcccgucucguaguccuu

SEQ ID NO: 4633 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
ucgucggugaagugggcacuu

SEQ ID NO: 4634 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
auccgaucacacagacaacuu

SEQ ID NO: 4635 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): PoPositions 1, 3, 5, 8-11, 13, 15, 17, 19, 21 2'-O-methyl ribonucleotide
  modified_base (1)..(21): Positions 2-3, 20-21 phosphorothioate linked nucleoside
cagcucugucucgcagaccuu

SEQ ID NO: 4636 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5,8-11, 13, 15, 17, 19, 21 2'-O-methyl ribonucleotide
  modified_base (1)..(21): Positions 2-3, 20-21 phosphorothioate linked nucleoside
aauuaaaggagagguggcuuu

SEQ ID NO: 4637 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
gaacugcuucacguggagcuu

SEQ ID NO: 4638 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
gaaccaguagcagcugcgcuu

SEQ ID NO: 4639 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
cgagagaaccaguagcagcuu

SEQ ID NO: 4640 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
ccggagcgagagaaccaguuu

SEQ ID NO: 4641 - DNA, 21 bp, Artificial Sequence
  Synthetic polynucleotide
  modified_base (1)..(1): 5'-monophosphate
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
gagaaccaguagcagcugcuu

SEQ ID NO: 4642 - DNA, 21 bp, Artificial Sequence
  Synthetic polynucleotide
  modified_base (1)..(21): Positions 2, 4, 6, 12, 14, 16, 18, 20 2'-deoxy-2'-fluoro ("2'-fluoro") ribonucleotide
  modified_base (1)..(21): Positions 1, 3, 5, 7-11, 13, 15, 17, 19, 21 2'-O-methyl ribonucleotide
  modified_base (1)..(21): Positions 2-3, 20-21 phosphorothioate linked nucleoside
gagaaccaguagcagcugcuu

SEQ ID NO: 4643 - DNA, 21 bp, Artificial Sequence
  Synthetic polynucleotide
  modified_base (1)..(1): 5'-monophosphate
  modified_base (1)..(21): Positions 2, 4, 6, 12, 14, 16, 18, 20 2'-deoxy-2'-fluoro ("2'-fluoro") ribonucleotide
  modified_base (1)..(21): Positions 7, 13, 19, 21 2'-O-methyl ribonucleotide
gagaaccaguagcagcugcuu

SEQ ID NO: 4644 - DNA, 21 bp, Artificial Sequence
  Synthetic polynucleotide
  modified_base (1)..(1): 5'-monophosphate
  modified_base (1)..(21): Positions 2, 4, 6, 8, 10, 13, 15, 17, 19, 21 2'-deoxy-2'-fluoro ("2'-fluoro") ribonucleotide
  modified_base (1)..(21): Positions 1, 3, 5, 7, 9, 11-12, 14, 16, 18, 20 2'-O-methyl ribonucleotide
  modified_base (1)..(21): Positions 2-3, 20-21 phosphorothioate linked nucleoside
acuucaucuuucuucccacuu

SEQ ID NO: 4645 - DNA, 21 bp, Artificial Sequence
  Synthetic polynucleotide
  modified_base (1)..(1): 5'-monophosphate
  modified_base (1)..(21): Positions 2, 4, 6, 8, 10, 13, 15, 17, 19, 21 2'-deoxy-2'-fluoro ("2'-fluoro") ribonucleotide
  modified_base (1)..(21): Positions 1, 3, 5, 7, 9, 11-12, 14, 16, 18, 20 2'-O-methyl ribonucleotide
  modified_base (1)..(21): Positions 2-3, 20-21 phosphorothioate linked nucleoside
acuucaucuuucuucccacuu

SEQ ID NO: 4646 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
uuuggucguggaggcccauuu

SEQ ID NO: 4647 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
guagcagcugcgcucgugcuu

SEQ ID NO: 4648 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
agcggccgucgucggugaauu

SEQ ID NO: 4649 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
cgucccguccacccacuucuu

SEQ ID NO: 4650 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
ugcuccucccaggacgugauu

SEQ ID NO: 4651 - DNA, 22 bp, Artificial Sequence
  Synthetic polynucleotide
  modified_base (1)..(1): 5'-monophosphate
  modified_base (1)..(22): Positions 2, 4, 6-7, 12, 14, 16, 18, 20 2'-deoxy-2'-fluoro ("2'-fluoro") ribonucleotide
  modified_base (1)..(22): Positions 1, 3, 5, 8-11, 13, 15, 17, 19, 21 2'-O-methyl ribonucleotide
  modified_base (1)..(22): Positions 2-3, 20-21 phosphorothioate linked nucleoside
  modified_base (22)..(22): inverted abasic nucleotide attached by 3'-3' linkage
  misc_feature (22)..(22): n is a, c, g, t or u
acuucaucuuucuucccacuun

SEQ ID NO: 4652 - DNA, 21 bp, Artificial Sequence
  Synthetic polynucleotide
  modified_base (1)..(1): 5'-monophosphate
  modified_base (1)..(21): Positions 2, 4, 6-7,  12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-4, 20-21 phosphorothioate linked nucleoside
acuucaucuuucuucccacuu

SEQ ID NO: 4653 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2, 20-21 phosphorothioate linked nucleoside
acuucaucuuucuucccacuu

SEQ ID NO: 4654 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 19-21 phosphorothioate linked nucleoside
acuucaucuuucuucccacuu

SEQ ID NO: 4655 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 21 phosphorothioate linked nucleoside
acuucaucuuucuucccacuu

SEQ ID NO: 4656 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 20-21 phosphorothioate linked nucleoside
acuucaucuuucuucccacuu

SEQ ID NO: 4657 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3 phosphorothioate linked nucleoside
acuucaucuuucuucccacuu

SEQ ID NO: 4658 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
gacgucgucguuccagcgguu

SEQ ID NO: 4659 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
gcacgccaaacguggcaucuu

SEQ ID NO: 4660 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
auugccucccugggugcucuu

SEQ ID NO: 4661 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
cucccugggugcucaagccuu

SEQ ID NO: 4662 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
agcgacuucaucuuucuucuu

SEQ ID NO: 4663 - DNA, 22 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
acsgccaaacguggcaucucuu

SEQ ID NO: 4664 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
cgucucguaguccgucccguu

SEQ ID NO: 4665 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
cuugaagcccgucucguaguu

SEQ ID NO: 4666 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
ggcaucuccagugcccggguu

SEQ ID NO: 4667 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
gaaagcgccacggguuucauu

SEQ ID NO: 4668 - DNA, 20 bp, Artificial Sequence
  Synthetic polynucleotide
  modified_base (1)..(1): 5'-monophosphate
  modified_base (1)..(20): Positions 2, 4, 6-7, 11, 13, 15, 17, 19, 21 2'-deoxy-2'-fluoro ("2'-fluoro") ribonucleotide
  modified_base (1)..(20): Positions 1, 3, 5, 8-10, 12, 14, 16, 18, 20 2'-O-methyl ribonucleotide
  modified_base (1)..(20): Positions 2-3, 10, 19-20 phosphorothioate linked nucleoside
cucccaggcgugaccaccuu

SEQ ID NO: 4669 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
ggugcuggacaaauuucuguu

SEQ ID NO: 4670 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
agcacgccaaacguggcauuu

SEQ ID NO: 4671 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
ucucucaggccccgcagcuuu

SEQ ID NO: 4672 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
uccuuggucaugauagggcuu

SEQ ID NO: 4673 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
ugcucgcugugaaguugcuuu

SEQ ID NO: 4674 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
ugcuggacaaauuucugcuuu

SEQ ID NO: 4675 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
cacuuccagggcccguuuuuu

SEQ ID NO: 4676 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
gccaucugacagcucaggcuu

SEQ ID NO: 4677 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
gccaaacguggcaucuccauu

SEQ ID NO: 4678 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
uugaagcccgucucguaguuu

SEQ ID NO: 4679 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
ccgucccguccacccacuuuu

SEQ ID NO: 4680 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
gguucuucagugcugugcauu

SEQ ID NO: 4681 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
agcccgucucguaguccguuu

SEQ ID NO: 4682 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
guggccguaccagucguccuu

SEQ ID NO: 4683 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
cucucaggccccgcagcucuu

SEQ ID NO: 4684 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
uccaagcacgccaaacguguu

SEQ ID NO: 4685 - DNA, 22 bp, Artificial Sequence
  Synthetic polynucleotide
  modified_base (1)..(1): 5'-monophosphate
  modified_base (1)..(1): inverted abasic nucleotide attached by 3'-3' linkage
  modified_base (1)..(21): Positions 3, 5, 7-8, 13, 15, 17, 19, 21 2'-deoxy-2'-fluoro ("2'-fluoro") ribonucleotide
  modified_base (1)..(21): Positions 2, 4, 6, 9-12, 14, 16, 18, 20, 22 2'-O-methyl ribonucleotide
  modified_base (1)..(21): Positions 3-4, 21-22 phosphorothioate linked nucleoside
  misc_feature (2)..(2): n is a, c, g, t or u
ancuucaucuuucuucccacuu

SEQ ID NO: 4686 - DNA, 23 bp, Artificial Sequence
  Synthetic polynucleotide
  modified_base (1)..(1): inverted abasic nucleotide attached by 3'-3' linkage
  modified_base (1)..(21): Positions 3, 5, 7-8, 13, 15, 17, 19, 21 2'-deoxy-2'-fluoro ("2'-fluoro") ribonucleotide
  modified_base (1)..(21): Positions 2, 4, 6, 9-12, 14, 16, 18, 20, 22 2'-O-methyl ribonucleotide
  modified_base (1)..(21): Positions 3-4, 21-22 phosphorothioate linked nucleoside
  misc_feature (1)..(1): n is a, c, g, t or u
  modified_base (2)..(2): 5'-monophosphate
  misc_feature (23)..(23): n is a, c, g, t or u
nacuucaucuuucuucccacuun

SEQ ID NO: 4687 - DNA, 21 bp, Artificial Sequence
  Synthetic polynucleotide
  modified_base (1)..(1): 5'-monophosphate
  modified_base (1)..(21): Positions 2, 4, 6-7, 12, 14, 16, 18, 20 2'-deoxy-2'-fluoro ("2'-fluoro") ribonucleotide
  modified_base (1)..(21): Positions 1, 3, 5, 8-11, 13, 15, 17, 19, 21 2'-O-methyl ribonucleotide
  modified_base (1)..(21): Positions 2-3, 20-21 phosphorothioate linked nucleoside
acuucaucuuucuucccacuu

SEQ ID NO: 4688 - DNA, 19 bp, Artificial Sequence
  Synthetic polynucleotide
caggctggagtgatcttca

SEQ ID NO: 4689 - DNA, 19 bp, Artificial Sequence
  Synthetic polynucleotide
ttcagcaacttcacagcga

SEQ ID NO: 4690 - DNA, 9 bp, Artificial Sequence
  Synthetic polynucleotide
tctttcttc

SEQ ID NO: 4691 - DNA, 16 bp, Artificial Sequence
  Synthetic polynucleotide
ccacattgcctccctg

SEQ ID NO: 4692 - DNA, 22 bp, Artificial Sequence
  Synthetic polynucleotide
gtttttgatccagacccagatg

SEQ ID NO: 4693 - DNA, 21 bp, Artificial Sequence
  Synthetic polynucleotide
gcccattattcagagcgagta

SEQ ID NO: 4694 - DNA, 9 bp, Artificial Sequence
  Synthetic polynucleotide
tgcagggtt

SEQ ID NO: 4695 - DNA, 14 bp, Artificial Sequence
  Synthetic polynucleotide
tcaccaggatccac

SEQ ID NO: 4696 - protein, 448 aa, Artificial Sequence
  Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDSSPYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPCVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4697 - protein, 214 aa, Artificial Sequence
  Synthetic polypeptide
DIQMTQSPSSVSASVGDRVTITCRASQGISSWLAWYQQKPGKAPKLLIYGASSLQSGVPSRFSASGSGTDFTLTISSLQPEDFATYYCQQSDSFPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4698 - DNA, 21 bp, Artificial Sequence
  Synthetic polynucleotide
  modified_base (1)..(21): Positions 1, 3, 5, 7, 9-11, 13, 15, 17, 19, 21 2'-deoxy-2'-fluoro ("2'-fluoro") ribonucleotide
  modified_base (1)..(21): Positions 2, 4, 6, 8, 12, 14, 16, 18, 20 2'-O-methyl ribonucleotide
  modified_base (1)..(21): Positions 2-3 phosphorothioate linked nucleoside
gugggaagaaagaugaaguuu

SEQ ID NO: 4699 - DNA, 21 bp, Artificial Sequence
  Synthetic polynucleotide
  modified_base (1)..(21): Positions 2, 4, 6, 8, 12, 14, 16, 18, 20 2'-deoxy-2'-fluoro ("2'-fluoro") ribonucleotide
  modified_base (1)..(21): Positions 1, 3, 5, 7, 9-11, 13, 15, 17, 19, 21 2'-O-methyl ribonucleotide
  modified_base (1)..(21): Positions 2-3, 20-21 phosphorothioate linked nucleoside
acuucaucuuucuucccacuu

What is claimed:

1. An RNAi construct comprising a sense strand and an antisense strand, wherein the antisense strand comprises a region having a sequence that is complementary to an ASGR1 mRNA sequence, and wherein said region comprises: (i) the sequence of nucleotides 1-19 of SEQ ID NO: 2651, (ii) the sequence of nucleotides 2-19 of SEQ ID NO: 2651, or (iii) the sequence of SEQ ID NO: 2651.

2. The RNAi construct of claim 1, wherein the sense strand comprises a sequence that is sufficiently complementary to the sequence of the antisense strand to form a duplex region of about 15 to about 30 base pairs in length.

3. The RNAi construct of claim 1, wherein the sense strand and the antisense strand are each about 18 to about 28 nucleotides in length.

4. The RNAi construct of claim 3, wherein the sense strand and the antisense strand are each about 19 to about 27 nucleotides in length.

5. The RNAi construct of claim 3, wherein the sense strand and the antisense strand are each about 21 to about 25 nucleotides in length.

6. The RNAi construct of claim 1, wherein the RNAi construct comprises at least one blunt end.

7. The RNAi construct of claim 1, wherein the RNAi construct comprises at least one nucleotide overhang of 1 to 4 unpaired nucleotides.

8. The RNAi construct of claim 7, wherein the RNAi construct comprises a nucleotide overhang at the 3' end of the sense strand, the 3' end of the antisense strand, or the 3' end of both the sense strand and the antisense strand.

9. The RNAi construct of claim 1, wherein the RNAi construct comprises at least one modified nucleotide.

10. The RNAi construct of claim 9, wherein the modified nucleotide is a 2'-modified nucleotide.

11. The RNAi construct of claim 9, wherein the modified nucleotide is a 2'-fluoro modified nucleotide, a 2'-O-methyl modified nucleotide, a 2'-O-methoxyethyl modified nucleotide, a 2'-O-allyl modified nucleotide, a bicyclic nucleic acid (BNA), or combinations thereof.

12. The RNAi construct of claim 9, wherein all of the nucleotides in the sense and antisense strands are modified nucleotides.

13. The RNAi construct of claim 12, wherein the modified nucleotides are 2'-O-methyl modified nucleotides, 2'-fluoro modified nucleotides, or combinations thereof.

14. The RNAi construct of claim 1, wherein the RNAi construct comprises at least one phosphorothioate internucleotide linkage.

15. The RNAi construct of claim 14, wherein the RNAi construct comprises two consecutive phosphorothioate internucleotide linkages at the 3' end of the antisense strand.

16. The RNAi construct of claim 14, wherein the RNAi construct comprises two consecutive phosphorothioate internucleotide linkages at both the 3' and 5' ends of the antisense strand and two consecutive phosphorothioate internucleotide linkages at the 5' end of the sense strand.

17. The RNAi construct of claim 1, wherein the antisense strand comprises the sequence of SEQ ID NO: 2650 or SEQ ID NO: 2651.

18. The RNAi construct of claim 17, wherein:
(a) the sense strand comprises the sequence of SEQ ID NO: 1147 and the antisense strand comprises the sequence of SEQ ID NO: 2650; or
(b) the sense strand comprises the sequence of SEQ ID NO: 1148 and the antisense strand comprises the sequence of SEQ ID NO: 2651.

19. The RNAi construct of claim 18, wherein:
(a) the sense strand comprises the sequence of modified nucleotides according to SEQ ID NO: 3050 and the antisense strand comprises the sequence of modified nucleotides according to SEQ ID NO: 3701;
(b) the sense strand comprises the sequence of modified nucleotides according to SEQ ID NO: 3051 and the antisense strand comprises the sequence of modified nucleotides according to SEQ ID NO: 3702;
(c) the sense strand comprises the sequence of modified nucleotides according to SEQ ID NO: 3065 and the antisense strand comprises the sequence of modified nucleotides according to SEQ ID NO: 3716;
(d) the sense strand comprises the sequence of modified nucleotides according to SEQ ID NO: 3067 and the antisense strand comprises the sequence of modified nucleotides according to SEQ ID NO: 3718;
(e) the sense strand comprises the sequence of modified nucleotides according to SEQ ID NO: 3071 and the antisense strand comprises the sequence of modified nucleotides according to SEQ ID NO: 3722;
(f) the sense strand comprises the sequence of modified nucleotides according to SEQ ID NO: 4420 and the antisense strand comprises the sequence of modified nucleotides according to SEQ ID NO: 4600; or
(g) the sense strand comprises the sequence of modified nucleotides according to SEQ ID NO: 4698 and the antisense strand comprises the sequence of modified nucleotides according to SEQ ID NO: 4699.

20. The RNAi construct of claim 1, wherein the sense strand comprises (i) the sequence of nucleotides 1-19 of SEQ ID NO: 1148, (ii) the sequence of nucleotides 2-19 of SEQ ID NO: 1148, or (iii) the sequence of SEQ ID NO: 1148.

21. The RNAi construct of claim 1, wherein the RNAi construct further comprises a ligand.

22. The RNAi construct of claim 21, wherein the ligand comprises a cholesterol moiety, a vitamin, a steroid, a bile acid, a folate moiety, a fatty acid, a carbohydrate, a glycoside, or antibody or antigen-binding fragment thereof.

23. The RNAi construct of claim 21, wherein the ligand targets delivery of the RNAi construct to hepatocytes.

24. The RNAi construct of claim 23, wherein the ligand comprises a monoclonal antibody or antigen-binding fragment thereof that specifically binds to human ASGR1.

25. The RNAi construct of claim 24, wherein the monoclonal antibody or antigen-binding fragment thereof comprises a substitution of at least one amino acid with a cysteine amino acid, and wherein the sense strand is covalently attached to the monoclonal antibody or antigen-binding fragment thereof through the side chain of the cysteine amino acid.

26. The RNAi construct of claim 21, wherein the ligand comprises galactose, galactosamine, or N-acetyl-galactosamine.

27. The RNAi construct of claim 26, wherein the ligand comprises a multivalent galactose moiety or multivalent N-acetyl-galactosamine moiety.

28. The RNAi construct of claim 27, wherein the multivalent galactose moiety or multivalent N-acetyl-galactosamine moiety is trivalent or tetravalent.

29. The RNAi construct of claim 21, wherein the ligand is covalently attached to the sense strand optionally through a linker.

30. The RNAi construct of claim 29, wherein the ligand is covalently attached to the 3' end or 5' end of the sense strand.

31. The RNAi construct of claim 1, wherein the sense strand comprises a sequence that is sufficiently complementary to the sequence of the antisense strand to form a duplex region of about 19 to about 25 base pairs in length.

32. A pharmaceutical composition comprising the RNAi construct of claim 1 and a pharmaceutically acceptable carrier, excipient, or diluent.

33. A method for reducing the expression of ASGR1 in a patient in need thereof comprising administering to the patient the RNAi construct of claim 1.

34. A method for reducing non-HDL cholesterol in a patient in need thereof comprising administering to the patient the RNAi construct of claim 1.

35. A method for treating cardiovascular disease in a patient in need thereof comprising administering to the patient the RNAi construct of claim 1.

36. A method for reducing the risk of myocardial infarction in a patient in need thereof comprising administering to the patient the RNAi construct of claim 1.

* * * * *